(12) United States Patent
Freier et al.

(10) Patent No.: US 11,118,183 B2
(45) Date of Patent: *Sep. 14, 2021

(54) MODULATION OF ANGIOPOIETIN-LIKE 3 EXPRESSION

(71) Applicant: Ionis Pharmaceuticals, Inc., Carlsbad, CA (US)

(72) Inventors: Susan M. Freier, San Diego, CA (US); Mark J. Graham, San Clemente, CA (US); Rosanne M. Crooke, Carlsbad, CA (US)

(73) Assignee: Ionis Pharmaceuticals, Inc., Carlsbad, CA (US)

(*) Notice: Subject to any disclaimer, the term of this patent is extended or adjusted under 35 U.S.C. 154(b) by 0 days.

This patent is subject to a terminal disclaimer.

(21) Appl. No.: 16/125,584

(22) Filed: Sep. 7, 2018

(65) Prior Publication Data

US 2019/0062755 A1    Feb. 28, 2019

Related U.S. Application Data

(63) Continuation of application No. 15/108,099, filed as application No. PCT/US2014/072303 on Dec. 24, 2014, now abandoned.

(60) Provisional application No. 61/920,652, filed on Dec. 24, 2013.

(51) Int. Cl.
C12N 15/113    (2010.01)

(52) U.S. Cl.
CPC ........ *C12N 15/1136* (2013.01); *C12N 15/113* (2013.01); *C12N 2310/11* (2013.01); *C12N 2310/315* (2013.01); *C12N 2310/321* (2013.01); *C12N 2310/3231* (2013.01); *C12N 2310/3341* (2013.01); *C12N 2310/346* (2013.01); *C12N 2310/351* (2013.01); *C12N 2320/30* (2013.01); *C12N 2320/53* (2013.01)

(58) Field of Classification Search
CPC .............. C12N 15/1136; C12N 15/113; C12N 2310/315; C12N 2310/321; C12N 2310/3231; C12N 2310/3341; C12N 2310/351; C12N 2320/30; C12N 2310/11; C12N 2310/346; C12N 2320/53; C12N 2310/341; C12N 2310/322; C12N 2310/3525; A61P 9/00; A61P 43/00; A61P 3/04; A61P 3/00; A61K 31/7105; A61K 31/7115; A61K 31/712; A61K 31/7125

See application file for complete search history.

(56) References Cited

U.S. PATENT DOCUMENTS

| | | |
|---|---|---|
| 4,981,957 A | 1/1991 | Lebleu et al. |
| 5,034,506 A | 7/1991 | Summerton et al. |
| 5,118,800 A | 6/1992 | Smith et al. |
| 5,166,315 A | 11/1992 | Summerton et al. |
| 5,185,444 A | 2/1993 | Summerton et al. |
| 5,319,080 A | 6/1994 | Leumann |
| 5,359,044 A | 10/1994 | Cook et al. |
| 5,393,878 A | 2/1995 | Leumann |
| 5,446,137 A | 8/1995 | Maag et al. |
| 5,466,786 A | 11/1995 | Buhr et al. |
| 5,514,785 A | 5/1996 | Van Ness et al. |
| 5,519,134 A | 5/1996 | Acevedo et al. |
| 5,567,811 A | 10/1996 | Mistura et al. |
| 5,576,427 A | 11/1996 | Cook et al. |
| 5,591,722 A | 1/1997 | Montgomery et al. |
| 5,597,909 A | 1/1997 | Urdea et al. |
| 5,610,300 A | 3/1997 | Altmann et al. |
| 5,627,053 A | 5/1997 | Usman et al. |
| 5,639,873 A | 6/1997 | Barascut et al. |
| 5,646,265 A | 7/1997 | McGee |
| 5,670,633 A | 9/1997 | Cook et al. |
| 5,698,685 A | 12/1997 | Summerton et al. |
| 5,700,920 A | 12/1997 | Altmann et al. |
| 5,792,847 A | 8/1998 | Buhr et al. |
| 5,801,154 A | 9/1998 | Baracchini et al. |
| 6,268,490 B1 | 7/2001 | Imanishi et al. |
| 6,525,191 B1 | 2/2003 | Ramasamy |
| 6,582,908 B2 | 6/2003 | Fodor et al. |
| 6,600,032 B1 | 7/2003 | Manoharan et al. |
| 6,670,461 B1 | 12/2003 | Wengel et al. |
| 6,673,661 B1 | 1/2004 | Liu et al. |
| 6,770,748 B2 | 8/2004 | Imanishi et al. |
| 6,794,499 B2 | 9/2004 | Wengel et al. |
| 7,034,133 B2 | 4/2006 | Wengel et al. |

(Continued)

FOREIGN PATENT DOCUMENTS

| | | |
|---|---|---|
| CA | 2450022 A1 | 12/2002 |
| WO | 9839352 A1 | 9/1998 |

(Continued)

OTHER PUBLICATIONS

Extended European Search Report for 18174926.8 dated Nov. 23, 2018.

(Continued)

*Primary Examiner* — J. E. Angell

(74) *Attorney, Agent, or Firm* — Arnold & Porter Kaye Scholer LLP

(57) ABSTRACT

Provided herein are methods, compounds, and compositions for reducing expression of an ANGPTL3 mRNA and protein in an animal. Also provided herein are methods, compounds, and compositions for reducing lipids and/or glucose in an animal. Such methods, compounds, and compositions are useful to treat, prevent, delay, or ameliorate any one or more of cardiovascular disease and/or metabolic disease, or a symptom thereof, in an individual in need thereof.

16 Claims, No Drawings

Specification includes a Sequence Listing.

(56) References Cited

U.S. PATENT DOCUMENTS

| | | |
|---|---|---|
| 7,053,207 B2 | 5/2006 | Wengel |
| 7,267,819 B2 | 9/2007 | Ferrara et al. |
| 7,399,845 B2 | 7/2008 | Seth et al. |
| 7,427,672 B2 | 9/2008 | Imanishi et al. |
| 8,278,283 B2 | 10/2012 | Seth et al. |
| 8,278,425 B2 | 10/2012 | Prakash et al. |
| 8,278,426 B2 | 10/2012 | Seth et al. |
| 8,501,805 B2 | 8/2013 | Seth et al. |
| 8,546,556 B2 | 10/2013 | Seth et al. |
| 8,653,047 B2 | 2/2014 | Crooke et al. |
| 9,139,831 B2 | 9/2015 | Crooke et al. |
| 9,322,018 B2 | 4/2016 | Bettencourt et al. |
| 2001/0053519 A1 | 12/2001 | Fodor et al. |
| 2003/0017488 A1 | 1/2003 | Koishi et al. |
| 2003/0228597 A1 | 12/2003 | Cowsert et al. |
| 2004/0171570 A1 | 9/2004 | Allerson et al. |
| 2004/0214325 A1 | 10/2004 | Crooke et al. |
| 2005/0130923 A1 | 6/2005 | Bhat et al. |
| 2005/0255487 A1 | 11/2005 | Khvorova et al. |
| 2007/0031844 A1 | 2/2007 | Khvorova et al. |
| 2007/0054856 A1 | 3/2007 | Gerber et al. |
| 2007/0287831 A1 | 12/2007 | Seth et al. |
| 2008/0039618 A1 | 2/2008 | Allerson et al. |
| 2008/0113351 A1 | 5/2008 | Nalto et al. |
| 2008/0177045 A1 | 7/2008 | Lee et al. |
| 2008/0255030 A1 | 10/2008 | Yu et al. |
| 2009/0012281 A1 | 1/2009 | Swayze et al. |
| 2009/0098117 A1 | 4/2009 | Ferrara et al. |
| 2009/0318536 A1 | 12/2009 | Freier et al. |
| 2011/0086342 A1 | 4/2011 | Esumi et al. |
| 2011/0117609 A1 | 5/2011 | Kurosawa et al. |
| 2011/0243948 A1 | 10/2011 | Lee et al. |
| 2013/0023579 A1 | 1/2013 | Crooke et al. |
| 2015/0057329 A1 | 2/2015 | Bhanot et al. |
| 2016/0060626 A1 | 3/2016 | Crooke et al. |
| 2017/0037409 A1 | 2/2017 | Freier et al. |

FOREIGN PATENT DOCUMENTS

| | | |
|---|---|---|
| WO | 9914226 A2 | 3/1999 |
| WO | 0063364 A2 | 10/2000 |
| WO | 0105825 A2 | 1/2001 |
| WO | WO 2002/101039 | 12/2002 |
| WO | 03004602 A2 | 1/2003 |
| WO | 03044172 A2 | 5/2003 |
| WO | 2003/100101 | 12/2003 |
| WO | 2004011624 A2 | 2/2004 |
| WO | 2004035765 A2 | 4/2004 |
| WO | 2004072046 A2 | 8/2004 |
| WO | 2004106356 A1 | 12/2004 |
| WO | 2005021570 A1 | 3/2005 |
| WO | 2005121371 A2 | 12/2005 |
| WO | 2006006948 A2 | 1/2006 |
| WO | WO 2006/014729 | 2/2006 |
| WO | 2006/034348 | 3/2006 |
| WO | 2007134181 A2 | 11/2007 |
| WO | 2008073300 A2 | 6/2008 |
| WO | 2008101157 A1 | 8/2008 |
| WO | 2008150729 A2 | 12/2008 |
| WO | 2008154401 A2 | 12/2008 |
| WO | 2009006478 A2 | 1/2009 |
| WO | 2011/085271 A2 | 7/2011 |
| WO | 2012177784 A2 | 12/2012 |
| WO | 2013142571 A2 | 9/2013 |

OTHER PUBLICATIONS

Yilmaz et al., "Serum concentrations of human angiopoietin-like protein 3 in patients with nonalcoholic fatty liver disease: association with insulin resistance" Eur J Gastroenterol Hepatol (2009) 21(11): 1247-1251.

Extended European Search Report for EP 14874081.4, Jul. 19, 2017, 10 pages.

Gao et al., "Angiopoietin-like protein 3 regulates the motility and permeability of podocytes by altering nephrin expression in vitro," Biochem. Biophys. Res. Comm. 399, 31-36, 2010.

Graham et al., "Cardiovascular and Metabolic Effects of ANGPTL3 Antisense Oligonucleotides," New Engl. J. Med. 2017.

Graham et al., "Cardiovascular and Metabolic Effects of ANGPTL3 Antisense Oligonucleotides," Supplementary Appendix, New Engl. J. Med. 2017.

Norata et al., "Gene silencing approaches for the management of dyslipidaemia," Trends in Pharmacol. Sci. 34, 198-205, 2013.

Sehgal et al., "Liver as a target for oligonucleotide therapeutics," J. Hepatology 59, 1354-59, 2013.

Yu et al., "Effects of ANGPTL3 antisense oligodeoxynucleotide transfection on the cell growth and invasion of human hepatocellular carcinoma cells," Hepato-Gastroenterology 58, 1742-46, 2011.

New England Biolabs 1998/99 Catalog (cover page and pp. 121 and 284).

Noto et al., "Prevalence of ANGPTL3 and APOB gene mutations in subjects with combined hypolipidemia" Arterioscler. Thromb. Vasc. Biol. (2012) 32(3):805-809.

Orum et al., "Locked nucleic acids: A promising molecular family for gene-function analysis and antisense drug development" Curr. Opinion Mol. Ther. (2001) 3:239-243.

Pisciotta et al., "Characterization of three kindreds with familial combined hypolipidemia caused by loss-of-function mutations of ANGPTL3." Circulation Cardiovasc Genet (2012) 5: 42-50.

Reynolds et al., "Rational siRNA design for RNA interference" Nature Biotechnology (2004) 22(3):326-330.

Romeo et al. "Rare loss-of-function mutations in ANGPTL family members contribute to plasma triglyceride levels in humans" J Clin Invest, 119(1): 70-79.

Sanan et al., "Low density lipoprotein receptor-negative mice expressing human apolipoprotein B-100 develop complex atherosclerotic lesions on a chow diet: No accentuation by apolipoprotein(a)" PNAS (1998) 95:4544-4549.

Sanghvi et al., "Heterocyclic Base Modifications in Nucleic Acids and Their Applications in Antisense Oligonucleotides" Antisense Research and Applications (1993) pp. 273-288.

Shimamura et al., "Angiopoietin-like protein3 regulates plasma HDL cholesterol through suppression of endothelial lipase" Arterioscler Thromb Vasc Biol. (2007) 27(2):366-372.

Shimamura et al., "Leptin and insulin down-regulate angiopoietin-like protein 3, a plasma triglyceride-increasing factor" Biochem. Biophys. Res. Commun. (2004) 322:1080-1085.

Shimamura et al., Biochem. Biophys. Res. Commun. (2003) 301:604-609.

Shimizugawa et al., "ANGPTL3 decreases very low density lipoprotein triglyceride clearance by inhibition of lipoprotein lipase" J. Biol. Chem. (2002) 277:33742-33748.

Sindelka et al., "Association of Obesity, Diabetes, Serum Lipids and Blood Pressure Regulates Insulin Action" Physiol. Res. (2002) 51:85-91.

Singh et al., "LNA (locked nucleic acids): synthesis and high-affinity nucleic acid recognition" Chem. Commun. (1998) 455-456.

Singh et al., "Synthesis of 2'-amino-LNA: A novel conformationally restricted high-affinity oligonucleotide analogue with a handle" J. Org. Chem. (1998) 63: 10035-10039.

Sonnenburg et al., "GPIHBP1 stabilizes lipoprotein lipase and prevents its inhibition by angiopoietin-like 3 and angiopoietin-like 4" The Journal of Lipid Research (2009) 50(12): 2421-2429.

Srivastava et al., "Five- and Six-Membered Conformationally Locked 2',4'-Carbocyclic ribo-Thymidines: Synthesis, Structure, and Biochemical Studies" J. Am. Chem. Soc. (2007) 129(26):8362-8379.

Thomas et al., "Development of Apolipoprotein B antisense Molecules as a Therapy for Hyperlipidemia," Current Atherosclerosis Reports (2009) 12: 58-65.

Valdivielso et al., "Association of moderate and severe hypertriglyceridemia with obesity, diabetes mellitus and vascular disease in the Spanish working population: Results of the ICARIA study" Atherosclerosis (2009) 207 (2):573-578.

Verdel et al., "RNAi-mediated targeting of heterochromatin by the RITS complex." Science (2004) 303(5658): 672-676.

(56) References Cited

OTHER PUBLICATIONS

Volpe et al., "Regulation of heterochromatic silencing and histone H3 lysine-9 methylation by RNAi" Science (2002) 297(5588):1833:1837.
Wahlestedt et al., "Potent and nontoxic antisense oligonucleotide containing locked nucleic acids" Proc. Natl. Acad. Sci. USA (2000) 97: 5633-5638.
Willer et al., "Newly identified loci that influence lipid concentrations and risk of coronary artery disease" Nature Genetics (2008) 40(2):161-169.
Woolf et al. "Specificity of antisense oligonucleotides in vivo" PNAS (1992) 89:7305-7309.
Zhang et al., "Spontaneous atherosclerosis in aged lipoprotein lipase-deficient mice with severe hypertriglyceridemia on a normal chow diet" Circ. Res. (2008) 102(2):250-256.
Zhou et al., "Fine Tuning of Electrostatics around the Internucleotidic Phosphate through Incorporation of Modified 2',4'-Carbocyclic-LNAs and -ENAs Leads to Significant Modulation of Antisense Properties" J. Org. Chem. (2009) 74:118-134.
Akdim et al., "Antisense apolipoprotein B therapy: where do we stand?" Current Opinion in Lipidology (2007) 18:397-400.
Albaek et al., "Analogues of a Locked Nucleic Acid with Three-Carbon 2',4'-Linkages: Synthesis by Ring-Closing Metathesis and Influence of Nucleic AcidDuplex Stability" J. Org. Chem. (2006) 71:7731-7740.
Allshire, "RNAi and Heterochromatin—a Hushed-Up Affair" Science (2003) 297: 1818-1819.
Altmann et al., "Second Generation Antisense Oligonucleotides— Inhibition of PKC-a and c-RAF Kinase Expression by Chimeric Oligonucleotides Incorporating 6'-Substituted Carbocyclic Nucleosides and 2'-O-Ethylene Glycol Substituted Ribonucleosides" Nucleosides Nucleotides (1997) 16: 917-926.
Altmann et al., "Second Generation of Antisense Oligonucleotides: From Nuclease Resistance to Biological Efficacy in Animals" Biochem. Soc. Trans. (1996) 24: 630-637.
Altmann et al., "Second-generation antisense oligonucleotides: structure-activity relationships and the design of improved signal-transduction inhibitors" Chimia (1996) 50: 168-176.
Ando et al., "A decreased expression of angiopoietin-like 3 is protective against atherosclerosis in apoE-deficient mice" Journal o Lipid Research (2003) 44(6):1215-1223.
Angelakopoulou et al., "Comparative analysis of genome-wide association studies signals for lipids, diabetes, and coronary heart disease: Cardiovascular Biomarker Genetics Collaboration" Eur Heart J. (2012) 33(3):393-407.
Baker et al., "2'-O-(2-Methoxy)ethyl-modified Anti-intercellular Adhesion Molecule 1 (ICAM-1) Oligonucleotides Selectively Increase the ICAM-1 mRNA Level and Inhibit Formation of the ICAM-1 Translation Initiation Complex in Human Umbilical Vein Endothelial Cells" J. Biol. Chem. (1997) 272: 11944-12000.
Braasch et al., "Locked nucleic acid (LNA): fine-tuning the recognition of DNA and RNA" Chem. Biol. (2001) 8:1-7.
Braasch et al., "Novel Antisense and Peptide Nucleic Acid Strategies for Controlling Gene Expression" Biochemistry (2002) 41: 4503-4510.
Branch et al., "A good antisense molecule is hard to find," TIBS (1998) 23:45-50.
Browning et al., "Molecular mediators of hepatic steatosis and liver injury" J. Clin. Invest. (2004) 114:147-152.
Camenisch et al., "ANGPTL3 stimulates endothelial cell adhesion and migration via integrin alpha vbeta 3 and induces blood vessel formation in vivo." J. Biol. Chem. (2002) 277(19)17281-17290.
Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.
Conklin et al., "Identification of a mammalian angiopoietin-related protein expressed specifically in liver." Genomics (1999) 62(3):477-482.

Crooke et al., "Basic Principles of Antisense Therapeutics" Antisense Research and Application (1998) Chapter 1:1-50.
Elayadi et al., "Application of PNA and LNA oligomers to chemotherapy" Curr. Opinion Invens. Drugs (2001) 2:558-561.
EMBL Accession No. BG400407, Homo sapiens cDNA clone, Mar. 17, 2001, retrieved from the Internet, Apr. 3, 2013 <http://www.ebi.ac.uk/Tools/dbfetch/emblfetch?id=BG400407&Submit=Go>.
European Search Report for application EP 11732249.5 dated Aug. 7, 2014.
Freier et al., "The ups and downs of nucleic acid duplex stability: structure-stability studies on chemically-modified DNA:RNA duplexes" Nucleic Acids Research (1997) 25(22):4429-4443.
Frieden et al., "Expanding the design horizon of antisense oligonucleotides with alpha-L-LNA" Nucleic Acids Research (2003) 31(21):6365-6372.
Fujimoto et al., "Angptl3-null mice show low plasma lipid concentrations by enhanced lipoprotein lipase activity" Exp. Anim (2006) 55(1):27-34.
Gautschi et al., "Activity of a Novel bcl-2/bcl-xL-Bispecific Antisense Oligonucleotide Against Tumors of Diverse Histologic Origins" J. Natl. Cancer Inst. (2001) 93:463-471.
GenBank Accession No. NM_014495.1. Homo sapiens angiopoietin-like 3 (ANGPTL3) mRNA, retrieved from the Internet on Apr. 18, 2013, downloaded from http://www.ncbi.nlm.nih.gov/nuccore/NM_014495.1.
Hall et al., "Establishment and maintenance of a heterochromatin domain" Science (2002) 297(5590):2232-2237.
Hatsuda et al., "Association between Plasma Angiopoietin-Like Protein 3 and Arterial Wall Thickness in Healthy Subjects" J Vasc Res (2007) 44:61-66.
Hooper et al., "Recent developments in the genetics of LDL deficiency" Curr Opin Lipidol (2013) 24(2):111-115.
Ichimura et al., "Serum Angiopoietin-like Protein 3 Levels: Possible Correlation with Progressive Skin Sclerosis, Digital Ulcers and Pulmonary Vascular Involvement in Patients with Systemic Sclerosis" Acta Derma Venereol (2013) 1-6.
Inaba et al., "Angiopoietin-like protein 3 mediates hypertriglyceridemia induced by the liver X receptor." J. Biol. Chem. (2003) 278(24):21344-21351.
International Search Report for application PCT/US11/20606 dated Jun. 27, 2011.
Inukai et al., "ANGPTL3 is increased in both insulin-deficient and -resistant diabetic states." Biochem. Biophys. Res. Commun. (2004) 317(4):1075-1079.
Ishibashi et al., "Hypercholesterolemia in low density lipoprotein receptor knockout mice and its reversal by adenovirus-mediated gene delivery." J. Clin. Invest. (1993) 92(2):883-893.
Kaplan et al., "Regulation of the angiopoietin-like protein 3 gene by LXR" J. Lipid Res. (2003) 44(1):136-143.
Koishi et al., "Angptl3 regulates lipid metabolism in mice" Nat. Genet. (2002) 30(2):151-157.
Korstanje et al., "Locating Ath8, a locus for murine atherosclerosis susceptibility and testing several of its candidate genes in mice and humans" Atherosclerosis (2004) 177:443-450.
Koshkin et al., "LNA (locked nucleic acids): Synthesis of the adenine, cytosine, guanine, 5-methylcytosine, thymine and uracil bicyclonucleoside monomers, oligomerisation, and unprecedented nucleic acid recognition" Tetrahedron (1998) 54:3607-3630.
Koster et al., "Transgenic angiopoietin-like (angptl)4 overexpression and targeted disruption of angptl4 and angptl3: regulation of triglyceride metabolism" Endocrinology (2005) 146(11): 4943-4950.
Kumar et al., "The first analogues of LNA (locked nucleic acids): phosphorothioate-LNA and 2'-thio-LNA" Bioorg Med Chem Lett. (1998) 8:2219-2222.
Lee et al., "Identification of a New Functional Domain in Angiopoietin-like 3 (ANGPTL3) and Angiopoietin-like 4 (ANGPTL4) Involved in Binding and Inhibition of Lipoprotein Lipase (LPL)" Journal of Biological Chemistry (2009) 284 (20): 13735-13745.
Leumann et al., "DNA Analogues: From Supramolecular Principles to Biological Properties" Bioorganic & Medicinal Chemistry (2002) 10:841-854.

(56) References Cited

OTHER PUBLICATIONS

Lichtenstein et al., "Modulation of plasma TG lipolysis by Angiopoietin-like proteins and GPIHBP1" Biochimica and Biophysica Acta (2010) 1804(4): 415-420.

Linton et al., "Transgenic mice expressing high plasma concentrations of human apolipoprotein B100 and lipoprotein (a)." J. Clin. Invest. (1993) 92: 3029-3037.

Maher et al., "Comparative hybrid arrest by tandem antisense oligodeoxyribonucleotides or oligodeoxyriboncleoside methylphosphonates in a cell-free system" Nuc. Acid. Res. (1988) 16:3341-3358.

Martin-Campos et al., "Identification of a novel mutation in the ANGPTL3 gene in two families diagnosed of familial hypobetalipoproteinemia without APOB mutation." Clin Chim Acta (2012) 413: 552-555.

Minicocci et al., "Clinical characteristics and plasma lipids in subjects with familial combined hypolipidemia: a pooled analysis" J of Lipid Research (2013) 54: 3481-3490.

Minicocci et al., "Mutations in the ANGPTL3 gene and familial combined hypolipidemia: a clinical and biochemical characterization" J. Clin. Endocrinol. Metab. (2012) 97(7):E1266-E1275.

Monia et al., "Selective Inhibition of Mutant Ha-ras mRNA Expression by Antisense Oligonucleotides," J. Biol. Chem. 267, 19954-62, 1992.

Musunuru et al., "Exome sequencing, ANGPTL3 mutations, and familial combined hypolipidemia" N. Engl. J. Med. (2010) 363(23):2220-2227.

Naoumova et al., A new drug target for treatment of dyslipidaemia associated with type 2 diabetes and the metabolic syndrome? Lancet (2002) 359(9325):2215-2216.

Fei Jai (ed.), Military Medical Science Press, siRNA Drug Development Technology, pp. 18-24 (Aug. 31, 2011).

International Search Report for application PCT/US14/072303 dated Apr. 28, 2015.

Kallanthottathil, "Conjugation Strategies for In Vivo siRNA Delivery," Oct. 29, 2012, 8th Annual meeting of the Oligonucleotide Therapeutics Society, presentation.

Li et al., "Research Development of ANGLPTL3," *Journal of Third Military Medical University*, 27(5):461-463 (2005).

Robciuc et al., "Angptl3 Deficiency is Associated with Increased Insulin Sensitivity, Lipoprotein Lipase Activity, and Decreased Serum Free Fatty Acids," *Arterioscler. Thromb. Vasc. Biol.*, 33:1706-1713 (2013).

Yilmaz et al., "Serum Concentrations of Human Angiopoietin-Like Protein 3 in Patients with Nonalcoholic Fatty Liver Disease: Association with Insulin Resistance," *Obesity Reviews*, 10:496-497 (2009).

MODULATION OF ANGIOPOIETIN-LIKE 3 EXPRESSION

SEQUENCE LISTING

The present application is being filed along with a Sequence Listing in electronic format. The Sequence Listing is provided as a file entitled BIOL0179USC1_ST25.txt, created on Sep. 5, 2018 which is 0.98 MB in size. The information in the electronic format of the sequence listing is incorporated herein by reference in its entirety.

FIELD OF THE INVENTION

Provided herein are methods, compounds, and compositions for reducing expression of angiopoietin-like 3 (ANGPTL3) mRNA and protein in an animal. Also, provided herein are methods, compounds, and compositions having an ANGPTL3 inhibitor for reducing ANGPTL3 related diseases or conditions in an animal. Such methods, compounds, and compositions are useful, for example, to treat, prevent, delay or ameliorate any one or more of cardiovascular disease or metabolic syndrome, or a symptom thereof, in an animal.

BACKGROUND

Diabetes and obesity (sometimes collectively referred to as "diabesity") are interrelated in that obesity is known to exacerbate the pathology of diabetes and greater than 60% of diabetics are obese. Most human obesity is associated with insulin resistance and leptin resistance. In fact, it has been suggested that obesity may have an even greater impact on insulin action than diabetes itself (Sindelka et al., *Physiol Res.*, 2002, 51, 85-91). Additionally, several compounds on the market for the treatment of diabetes are known to induce weight gain, a very undesirable side effect to the treatment of this disease.

Cardiovascular disease is also interrelated to obesity and diabetes. Cardiovascular disease encompasses a wide variety of etiologies and has an equally wide variety of causative agents and interrelated players. Many causative agents contribute to symptoms such as elevated plasma levels of cholesterol, including non-high density lipoprotein cholesterol (non-HDL-C), as well as other lipid-related disorders. Such lipid-related disorders, generally referred to as dyslipidemia, include hyperlipidemia, hypercholesterolemia and hypertriglyceridemia among other indications. Elevated non-HDL cholesterol is associated with atherogenesis and its sequelae, including cardiovascular diseases such as arteriosclerosis, coronary artery disease, myocardial infarction, ischemic stroke, and other forms of heart disease. These rank as the most prevalent types of illnesses in industrialized countries. Indeed, an estimated 12 million people in the United States suffer with coronary artery disease and about 36 million require treatment for elevated cholesterol levels.

Epidemiological and experimental evidence has shown that high levels of circulating triglyceride (TG) can contribute to cardiovascular disease and a myriad of metabolic disorders (Valdivielso et al., 2009, *Atherosclerosis* Zhang et al., 2008, *Circ Res.* 1; 102(2):250-6). TG derived from either exogenous or endogenous sources is incorporated and secreted in chylomicrons from the intestine or in very low density lipoproteins (VLDL) from the liver. Once in circulation, TG is hydrolyzed by lipoprotein lipase (LpL) and the resulting free fatty acids can then be taken up by local tissues and used as an energy source. Due to the profound effect LpL has on plasma TG and metabolism in general, discovering and developing compounds that affect LpL activity are of great interest.

Metabolic syndrome is a combination of medical disorders that increase one's risk for cardiovascular disease and diabetes. The symptoms, including high blood pressure, high triglycerides, decreased HDL and obesity, tend to appear together in some individuals. It affects a large number of people in a clustered fashion. In some studies, the prevalence in the USA is calculated as being up to 25% of the population. Metabolic syndrome is known under various other names, such as (metabolic) syndrome X, insulin resistance syndrome, Reaven's syndrome or CHAOS. With the high prevalence of cardiovascular disorders and metabolic disorders there remains a need for improved approaches to treat these conditions The angiopoietins are a family of secreted growth factors. Together with their respective endothelium-specific receptors, the angiopoietins play important roles in angiogenesis. One family member, angiopoietin-like 3 (also known as angiopoietin-like protein 3, ANGPT5, ANGPTL3, or angiopoietin 5), is predominantly expressed in the liver, and is thought to play a role in regulating lipid metabolism (Kaplan et al., *J. Lipid Res.*, 2003, 44, 136-143). Genome-wide association scans (GWAS) surveying the genome for common variants associated with plasma concentrations of HDL, LDL and triglyceride found an association between triglycerides and single-nucleotide polymorphisms (SNPs) near ANGPTL3 (Willer et al., Nature Genetics, 2008, 40(2): 161-169). Individuals with homozygous ANGPTL3 loss-of-function mutations present with low levels of all atherogenic plasma lipids and lipoproteins, such as total cholesterol (TC) and TG, low density lipoprotein cholesterol (LDL-C), apolipoprotein B (apoB), non-HDL-C, as well as HDL-C (Romeo et al. 2009, *J Clin Invest,* 119(1):70-79; Musunuru et al. 2010 *N Engl J Med,* 363:2220-2227; Martin-Campos et al. 2012, *Clin Chim Acta,* 413:552-555; Minicocci et al. 2012, *J Clin Endocrinol Metab,* 97:e1266-1275; Noto et al. 2012, *Arterioscler Thromb Vasc Biol,* 32:805-809; Pisciotta et al. 2012, *Circulation Cardiovasc Genet,* 5:42-50). This clinical phenotype has been termed familial combined hypolipidemia (FHBL2). Despite reduced secretion of VLDL, subjects with FHBL2 do not have increased hepatic fat content. They also appear to have lower plasma glucose and insulin levels, and importantly, both diabetes and cardiovascular disease appear to be absent from these subjects. No adverse clinical phenotypes have been reported to date (Minicocci et al. 2013, *J of Lipid Research*, 54:3481-3490). Reduction of ANGPTL3 has been shown to lead to a decrease in TG, cholesterol and LDL levels in animal models (U.S. Ser. No. 13/520,997; PCT Publication WO 2011/085271). Mice deficient in ANGPTL3 have very low plasma triglyceride (TG) and cholesterol levels, while overexpression produces the opposite effects (Koishi et al. 2002; Koster 2005; Fujimoto 2006). Accordingly, the potential role of ANGPTL3 in lipid metabolism makes it an attractive target for therapeutic intervention.

To date, therapeutic strategies to treat cardiometabolic disease by directly targeting ANGPTL3 levels have been limited. ANGPTL3 polypeptide fragments (U.S. Ser. No. 12/128,545), anti-ANGPTL3 antibodies (U.S. Ser. No. 12/001,012) and ANGPTL3 nucleic acid inhibitors including antisense oligonucleotides (U.S. Ser. No. 13/520,997; PCT Publication WO 2011/085271; incorporated by reference herein, in their entirety) have previously been suggested or developed, but none of the compounds directly targeting ANGPTL3 have been approved for treating cardiometabolic disease. Accordingly, there is an unmet need for highly potent and tolerable compounds to inhibit ANGPTL3. The invention disclosed herein relates to the discovery of novel, highly potent inhibitors of ANGPTL3 expression and their use in treatment.

SUMMARY OF THE INVENTION

Provided herein are compositions and methods for modulating expression of ANGPTL3 mRNA and protein. In certain embodiments, the composition is an ANGPTL3 specific inhibitor. In certain embodiments, the ANGPTL3 specific inhibitor decreases expression of ANGPTL3 mRNA and protein.

In certain embodiments, the composition is an ANGPTL3 specific inhibitor. In certain embodiments, the ANGPTL3 specific inhibitor is a nucleic acid. In certain embodiments, the nucleic acid is an antisense compound. In certain embodiments, the antisense compound is a modified oligonucleotide.

In certain embodiments, the ANGPTL3 specific inhibitor is a modified oligonucleotide consisting of 12 to 30 linked nucleosides and having a nucleobase sequence comprising at least 8, least 9, least 10, least 11, at least 12, least 13, at least 14, at least 15, at least 16, least 17, least 18, least 19, or 20 contiguous nucleobases of the nucleobase sequence of SEQ ID NO: 77.

In certain embodiments, the ANGPTL3 specific inhibitor is a modified oligonucleotide consisting of 12 to 30 linked nucleosides and comprising a nucleobase sequence comprising a portion of at least 8 contiguous nucleobases complementary to an equal length portion of nucleobases 1140-1159 of SEQ ID NO: 1, wherein the nucleobase sequence of the modified oligonucleotide is at least 80% complementary to SEQ ID NO: 1.

In certain embodiments, the ANGPTL3 specific inhibitor is a modified oligonucleotide consisting of 12 to 30 linked nucleosides and comprising a nucleobase sequence comprising a portion of at least 8 contiguous nucleobases complementary to an equal length portion of nucleobases 9715-9734 of SEQ ID NO: 2, wherein the nucleobase sequence of the modified oligonucleotide is at least 80% complementary to SEQ ID NO: 2.

In certain embodiments, the ANGPTL3 specific inhibitor is a modified oligonucleotide consisting of 20 linked nucleosides and having a nucleobase sequence comprising at least 8 contiguous nucleobases of SEQ ID NO: 77, wherein the modified oligonucleotide comprises: (a) a gap segment consisting of ten linked deoxynucleosides; (b) a 5' wing segment consisting of five linked nucleosides; (c) a 3' wing segment consisting of five linked nucleosides; and wherein the gap segment is positioned between the 5' wing segment and the 3' wing segment, wherein each nucleoside of each wing segment comprises a 2'-O-methoxyethyl sugar, wherein each internucleoside linkage is a phosphorothioate linkage and wherein each cytosine residue is a 5-methylcytosine.

In certain embodiments, the ANGPTL3 specific inhibitor is a modified oligonucleotide consisting of 20 linked nucleosides and having a nucleobase sequence consisting of at least 8 contiguous nucleobases of SEQ ID NO: 77, wherein the modified oligonucleotide consists of: (a) a gap segment consisting of ten linked deoxynucleosides; (b) a 5' wing segment consisting of five linked nucleosides; (c) a 3' wing segment consisting of five linked nucleosides; and wherein the gap segment is positioned between the 5' wing segment and the 3' wing segment, wherein each nucleoside of each wing segment comprises a 2'-O-methoxyethyl sugar, wherein each internucleoside linkage is a phosphorothioate linkage and wherein each cytosine residue is a 5-methylcytosine.

In certain embodiments, the ANGPTL3 specific inhibitor is a modified oligonucleotide represented by the following structure and the designation ISIS 563580. In certain embodiments, the ANGPTL3 specific inhibitor comprises the modified oligonucleotide ISIS 563580 represented by the following structure having SEQ ID NO: 77.

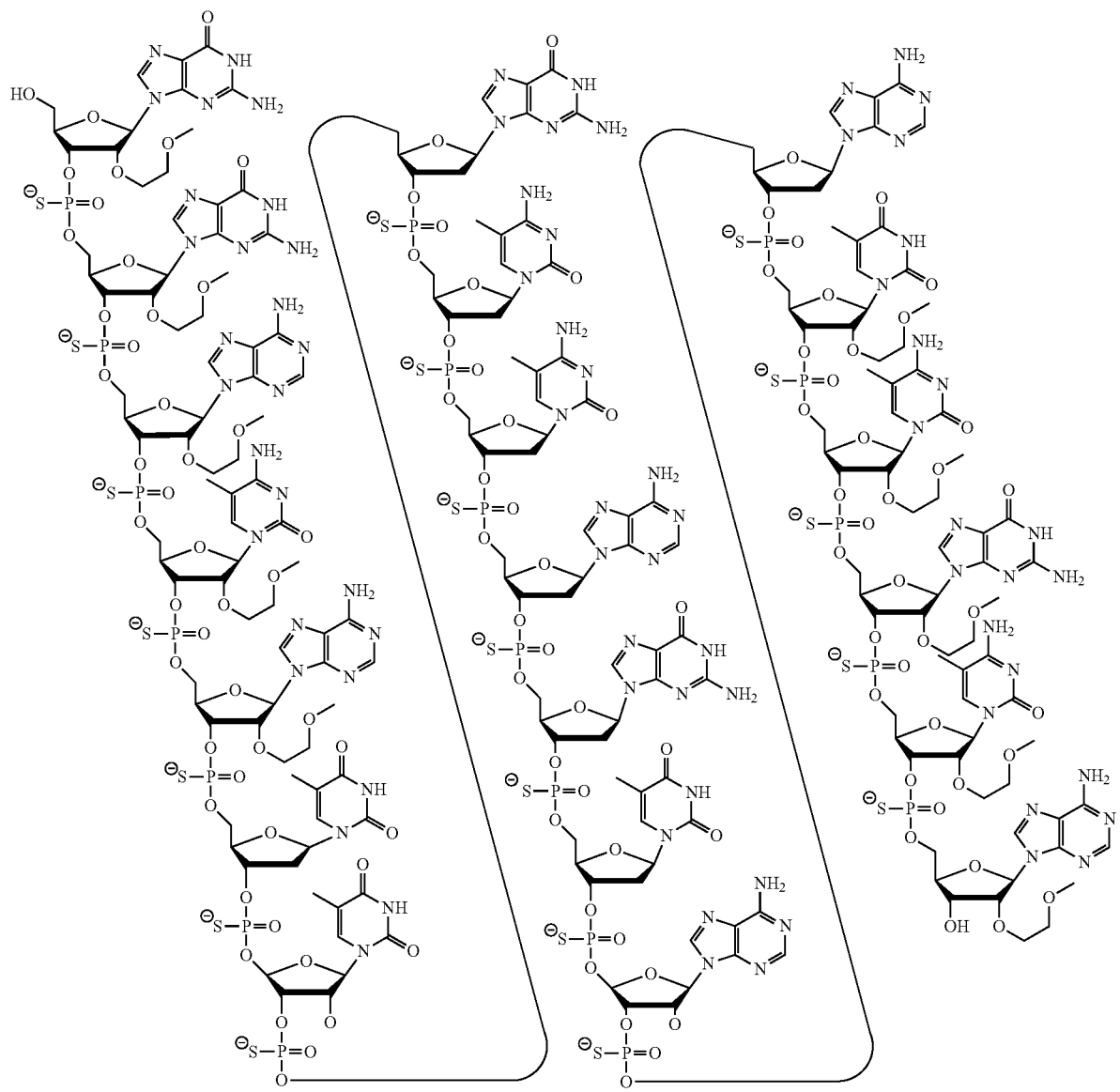

Certain embodiments provide a composition comprising a compound described herein, or a salt thereof, and a pharmaceutically acceptable carrier or diluent.

In certain embodiments, the modulation of ANGPTL3 expression occurs in a cell or tissue. In certain embodiments, the modulations occur in a cell or tissue in an animal. In certain embodiments, the animal is a human. In certain embodiments, the modulation is a reduction in ANGPTL3 mRNA level. In certain embodiments, the modulation is a reduction in ANGPTL3 protein level. In certain embodiments, both ANGPTL3 mRNA and protein levels are reduced. Such reduction may occur in a time-dependent or in a dose-dependent manner.

Certain embodiments provide compositions and methods for use in therapy. Certain embodiments provide compositions and methods for preventing, treating, delaying, slowing the progression and/or ameliorating ANGPTL3 related diseases, disorders, and conditions. In certain embodiments, such diseases, disorders, and conditions are cardiovascular and/or metabolic diseases, disorders, and conditions. In certain embodiments, the compositions and methods for therapy include administering an ANGPTL3 specific inhibitor to an individual in need thereof. In certain embodiments, the ANGPTL3 specific inhibitor is a nucleic acid. In certain embodiments, the nucleic acid is an antisense compound. In certain embodiments, the antisense compound is a modified oligonucleotide.

DETAILED DESCRIPTION OF THE INVENTION

It is to be understood that both the foregoing general description and the following detailed description are exemplary and explanatory only and are not restrictive of the invention, as claimed. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component"

encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this application, including, but not limited to, patents, patent applications, articles, books, and treatises, are hereby expressly incorporated-by-reference for the portions of the document discussed herein, as well as in their entirety.

Definitions

Unless specific definitions are provided, the nomenclature utilized in connection with, and the procedures and techniques of, analytical chemistry, synthetic organic chemistry, and medicinal and pharmaceutical chemistry described herein are those well known and commonly used in the art. Standard techniques can be used for chemical synthesis, and chemical analysis. Where permitted, all patents, applications, published applications and other publications, GENBANK Accession Numbers and associated sequence information obtainable through databases such as National Center for Biotechnology Information (NCBI) and other data referred to throughout in the disclosure herein are incorporated by reference for the portions of the document discussed herein, as well as in their entirety.

Unless otherwise indicated, the following terms have the following meanings:

"2'-O-methoxyethyl" (also 2'-MOE and 2'-O(CH$_2$)$_2$—OCH$_3$) refers to an O-methoxy-ethyl modification of the 2' position of a furosyl ring. A 2'-O-methoxyethyl modified sugar is a modified sugar.

"2'-O-methoxyethyl nucleotide" means a nucleotide comprising a 2'-O-methoxyethyl modified sugar moiety.

"3' target site" or "3' stop site" refers to the nucleotide of a target nucleic acid which is complementary to the 3'-most nucleotide of a particular antisense compound.

"5' target site" or "5 start site" refers to the nucleotide of a target nucleic acid which is complementary to the 5'-most nucleotide of a particular antisense compound.

"5-methylcytosine" means a cytosine modified with a methyl group attached to the 5' position. A 5-methylcytosine is a modified nucleobase.

"About" means within ±10% of a value. For example, if it is stated, "a marker may be increased by about 50%", it is implied that the marker may be increased between 45%-55%

"Active pharmaceutical agent" means the substance or substances in a pharmaceutical composition that provide a therapeutic benefit when administered to an individual. For example, in certain embodiments an antisense oligonucleotide targeted to ANGPTL3 is an active pharmaceutical agent.

"Active target region" or "target region" means a region to which one or more active antisense compounds is targeted.

"Active antisense compounds" means antisense compounds that reduce target nucleic acid levels or protein levels.

"Adipogenesis" means the development of fat cells from preadipocytes. "Lipogenesis" means the production or formation of fat, either fatty degeneration or fatty infiltration.

"Adiposity" or "Obesity" refers to the state of being obese or an excessively high amount of body fat or adipose tissue in relation to lean body mass. The amount of body fat includes concern for both the distribution of fat throughout the body and the size and mass of the adipose tissue deposits. Body fat distribution can be estimated by skin-fold measures, waist-to-hip circumference ratios, or techniques such as ultrasound, computed tomography, or magnetic resonance imaging. According to the Center for Disease Control and Prevention, individuals with a body mass index (BMI) of 30 or more are considered obese. The term "Obesity" as used herein includes conditions where there is an increase in body fat beyond the physical requirement as a result of excess accumulation of adipose tissue in the body. The term "obesity" includes, but is not limited to, the following conditions: adult-onset obesity; alimentary obesity; endogenous or metabolic obesity; endocrine obesity; familial obesity; hyperinsulinar obesity; hyperplastic-hypertrophic obesity; hypogonadal obesity; hypothyroid obesity; lifelong obesity; morbid obesity and exogenous obesity.

"Administered concomitantly" refers to the co-administration of two agents in any manner in which the pharmacological effects of both are manifest in the patient at the same time. Concomitant administration does not require that both agents be administered in a single pharmaceutical composition, in the same dosage form, or by the same route of administration. The effects of both agents need not manifest themselves at the same time. The effects need only be overlapping for a period of time and need not be coextensive.

"Administering" means providing an agent to an animal, and includes, but is not limited to, administering by a medical professional and self-administering.

"Agent" means an active substance that can provide a therapeutic benefit when administered to an animal. "First Agent" means a therapeutic compound of the invention. For example, a first agent can be an antisense oligonucleotide targeting ANGPTL3. "Second agent" means a second therapeutic compound of the invention (e.g. a second antisense oligonucleotide targeting ANGPTL3) and/or a non-ANGPTL3 therapeutic compound.

"Amelioration" refers to a lessening of at least one indicator, sign, or symptom of an associated disease, disorder, or condition. The severity of indicators can be determined by subjective or objective measures, which are known to those skilled in the art.

"ANGPTL3" means any nucleic acid or protein of ANGPTL3.

"ANGPTL3 expression" means the level of mRNA transcribed from the gene encoding ANGPTL3 or the level of protein translated from the mRNA. ANGPTL3 expression can be determined by art known methods such as a Northern or Western blot.

"ANGPTL3 nucleic acid" means any nucleic acid encoding ANGPTL3. For example, in certain embodiments, an ANGPTL3 nucleic acid includes a DNA sequence encoding ANGPTL3, a RNA sequence transcribed from DNA encoding ANGPTL3 (including genomic DNA comprising introns and exons), and a mRNA sequence encoding ANGPTL3. "ANGPTL3 mRNA" means a mRNA encoding an ANGPTL3 protein.

"Animal" refers to a human or non-human animal, including, but not limited to, mice, rats, rabbits, dogs, cats, pigs, and non-human primates, including, but not limited to, monkeys and chimpanzees.

"Antisense activity" means any detectable or measurable activity attributable to the hybridization of an antisense compound to its target nucleic acid. In certain embodiments, antisense activity is a decrease in the amount or expression of a target nucleic acid or protein encoded by such target nucleic acid.

"Antisense compound" means an oligomeric compound that is capable of undergoing hybridization to a target nucleic acid through hydrogen bonding.

"Antisense inhibition" means reduction of target nucleic acid levels or target protein levels in the presence of an antisense compound complementary to a target nucleic acid compared to target nucleic acid levels or target protein levels in the absence of the antisense compound.

"Antisense oligonucleotide" means a single-stranded oligonucleotide having a nucleobase sequence that permits hybridization to a corresponding region or segment of a target nucleic acid.

"ApoB-containing lipoprotein" means any lipoprotein that has apolipoprotein B as its protein component, and is understood to include LDL, VLDL, IDL, and lipoprotein(a) and can be generally targeted by lipid lowering agent and therapies. "ApoB-100-containing LDL" means ApoB-100 isoform containing LDL.

"Atherosclerosis" means a hardening of the arteries affecting large and medium-sized arteries and is characterized by the presence of fatty deposits. The fatty deposits are called "atheromas" or "plaques," which consist mainly of cholesterol and other fats, calcium and scar tissue, and damage the lining of arteries.

"Bicyclic sugar" means a furosyl ring modified by the bridging of two non-geminal ring atoms. A bicyclic sugar is a modified sugar.

"Bicyclic nucleic acid" or "BNA" refers to a nucleoside or nucleotide wherein the furanose portion of the nucleoside or nucleotide includes a bridge connecting two carbon atoms on the furanose ring, thereby forming a bicyclic ring system.

"Cap structure" or "terminal cap moiety" means chemical modifications, which have been incorporated at either terminus of an antisense compound.

"Cardiovascular disease" or "cardiovascular disorder" refers to a group of conditions related to the heart, blood vessels, or the circulation. Examples of cardiovascular diseases or disorders include, but are not limited to, aneurysm, angina, arrhythmia, atherosclerosis, cerebrovascular disease (stroke), coronary heart disease, hypertension, dyslipidemia, hyperlipidemia, and hypercholesterolemia.

"Cardiometabolic disease" or "cardiometabolic disorder" are diseases or disorders concerning both the cardiovascular system and the metabolic system. Examples of cardiometabolic diseases or disorders include, but are not limited to, diabetes and dyslipidemias.

"Chemically distinct region" refers to a region of an antisense compound that is in some way chemically different than another region of the same antisense compound. For example, a region having 2'-O-methoxyethyl nucleotides is chemically distinct from a region having nucleotides without 2'-O-methoxyethyl modifications.

"Chimeric antisense compound" means an antisense compound that has at least two chemically distinct regions.

"Co-administration" means administration of two or more agents to an individual. The two or more agents can be in a single pharmaceutical composition, or can be in separate pharmaceutical compositions. Each of the two or more agents can be administered through the same or different routes of administration. Co-administration encompasses parallel or sequential administration.

"Cholesterol" is a sterol molecule found in the cell membranes of all animal tissues. Cholesterol must be transported in an animal's blood plasma by lipoproteins including very low density lipoprotein (VLDL), intermediate density lipoprotein (IDL), low density lipoprotein (LDL), and high density lipoprotein (HDL). "Plasma cholesterol" refers to the sum of all lipoproteins (VDL, IDL, LDL, HDL) esterified and/or non-estrified cholesterol present in the plasma or serum.

"Cholesterol absorption inhibitor" means an agent that inhibits the absorption of exogenous cholesterol obtained from diet.

"Complementarity" means the capacity for pairing between nucleobases of a first nucleic acid and a second nucleic acid. In certain embodiments, complementarity between the first and second nucleic acid may be between two DNA strands, between two RNA strands, or between a DNA and an RNA strand. In certain embodiments, some of the nucleobases on one strand are matched to a complementary hydrogen bonding base on the other strand. In certain embodiments, all of the nucleobases on one strand are matched to a complementary hydrogen bonding base on the other strand. In certain embodiments, a first nucleic acid is an antisense compound and a second nucleic acid is a target nucleic acid. In certain such embodiments, an antisense oligonucleotide is a first nucleic acid and a target nucleic acid is a second nucleic acid.

"Contiguous nucleobases" means nucleobases immediately adjacent to each other.

"Coronary heart disease (CHD)" means a narrowing of the small blood vessels that supply blood and oxygen to the heart, which is often a result of atherosclerosis.

"Deoxyribonucleotide" means a nucleotide having a hydrogen at the 2' position of the sugar portion of the nucleotide. Deoxyribonucleotides may be modified with any of a variety of substituents.

"Diabetes mellitus" or "diabetes" is a syndrome characterized by disordered metabolism and abnormally high blood sugar (hyperglycemia) resulting from insufficient levels of insulin or reduced insulin sensitivity. The characteristic symptoms are excessive urine production (polyuria) due to high blood glucose levels, excessive thirst and increased fluid intake (polydipsia) attempting to compensate for increased urination, blurred vision due to high blood glucose effects on the eye's optics, unexplained weight loss, and lethargy.

"Diabetic dyslipidemia" or "type 2 diabetes with dyslipidemia" means a condition characterized by Type 2 diabetes, reduced HDL-C, elevated triglycerides, and elevated small, dense LDL particles.

"Diluent" means an ingredient in a composition that lacks pharmacological activity, but is pharmaceutically necessary or desirable. For example, the diluent in an injected composition can be a liquid, e.g. saline solution.

"Dyslipidemia" refers to a disorder of lipid and/or lipoprotein metabolism, including lipid and/or lipoprotein overproduction or deficiency. Dyslipidemias may be manifested by elevation of lipids such as cholesterol and triglycerides as well as lipoproteins such as low-density lipoprotein (LDL) cholesterol.

"Dosage unit" means a form in which a pharmaceutical agent is provided, e.g. pill, tablet, or other dosage unit known in the art. In certain embodiments, a dosage unit is a vial containing lyophilized antisense oligonucleotide. In certain embodiments, a dosage unit is a vial containing reconstituted antisense oligonucleotide.

"Dose" means a specified quantity of a pharmaceutical agent provided in a single administration, or in a specified time period. In certain embodiments, a dose can be administered in one, two, or more boluses, tablets, or injections. For example, in certain embodiments where subcutaneous administration is desired, the desired dose requires a volume not easily accommodated by a single injection, therefore, two or more injections can be used to achieve the desired dose. In certain embodiments, the pharmaceutical agent is administered by infusion over an extended period of time or continuously. Doses can be stated as the amount of pharmaceutical agent per hour, day, week, or month. Doses can be expressed as mg/kg or g/kg.

"Effective amount" or "therapeutically effective amount" means the amount of active pharmaceutical agent sufficient to effectuate a desired physiological outcome in an individual in need of the agent. The effective amount can vary among individuals depending on the health and physical condition of the individual to be treated, the taxonomic group of the individuals to be treated, the formulation of the composition, assessment of the individual's medical condition, and other relevant factors.

"Fully complementary" or "100% complementary" means each nucleobase of a nucleobase sequence of a first nucleic acid has a complementary nucleobase in a second nucleobase sequence of a second nucleic acid. In certain embodiments, a first nucleic acid is an antisense compound and a target nucleic acid is a second nucleic acid.

"Gapmer" means a chimeric antisense compound in which an internal region having a plurality of nucleosides that support RNase H cleavage is positioned between external regions having one or more nucleosides, wherein the nucleosides comprising the internal region are chemically distinct from the nucleoside or nucleosides comprising the external regions. The internal region can be referred to as a "gap segment" and the external regions can be referred to as "wing segments."

"Gap-widened" means a chimeric antisense compound having a gap segment of 12 or more contiguous 2'-deoxyribonucleosides positioned between and immediately adjacent to 5' and 3' wing segments having from one to six nucleosides.

"Glucose" is a monosaccharide used by cells as a source of energy and metabolic intermediate. "Plasma glucose" refers to glucose present in the plasma.

"High density lipoprotein-C(HDL-C)" means cholesterol associated with high density lipoprotein particles. Concentration of HDL-C in serum (or plasma) is typically quantified in mg/dL or nmol/L. "serum HDL-C" and "plasma HDL-C" mean HDL-C in serum and plasma, respectively.

"HMG-CoA reductase inhibitor" means an agent that acts through the inhibition of the enzyme HMG-CoA reductase, such as atorvastatin, rosuvastatin, fluvastatin, lovastatin, pravastatin, and simvastatin.

"Hybridization" means the annealing of complementary nucleic acid molecules. In certain embodiments, complementary nucleic acid molecules include an antisense compound and a target nucleic acid.

"Hypercholesterolemia" means a condition characterized by elevated cholesterol or circulating (plasma) cholesterol, LDL-cholesterol and VLDL-cholesterol, as per the guidelines of the Expert Panel Report of the National Cholesterol Educational Program (NCEP) of Detection, Evaluation of Treatment of high cholesterol in adults (see, *Arch. Int. Med.* (1988) 148, 36-39).

"Hyperlipidemia" or "hyperlipemia" is a condition characterized by elevated serum lipids or circulating (plasma) lipids. This condition manifests an abnormally high concentration of fats. The lipid fractions in the circulating blood are cholesterol, low density lipoproteins, very low density lipoproteins and triglycerides.

"Hypertriglyceridemia" means a condition characterized by elevated triglyceride levels.

"Identifying" or "selecting a subject having a metabolic or cardiovascular disease" means identifying or selecting a subject having been diagnosed with a metabolic disease, a cardiovascular disease, or a metabolic syndrome; or, identifying or selecting a subject having any symptom of a metabolic disease, cardiovascular disease, or metabolic syndrome including, but not limited to, hypercholesterolemia, hyperglycemia, hyperlipidemia, hypertriglyceridemia, hypertension, increased insulin resistance, decreased insulin sensitivity, above normal body weight, and/or above normal body fat content or any combination thereof. Such identification may be accomplished by any method, including but not limited to, standard clinical tests or assessments, such as measuring serum or circulating (plasma) cholesterol, measuring serum or circulating (plasma) blood-glucose, measuring serum or circulating (plasma) triglycerides, measuring blood-pressure, measuring body fat content, measuring body weight, and the like.

"Identifying" or "selecting a diabetic subject" means identifying or selecting a subject having been identified as diabetic or identifying or selecting a subject having any symptom of diabetes (type 1 or type 2) such as, but not limited to, having a fasting glucose of at least 110 mg/dL, glycosuria, polyuria, polydipsia, increased insulin resistance, and/or decreased insulin sensitivity.

"Identifying" or "selecting an obese subject" means identifying or selecting a subject having been diagnosed as obese or identifying or selecting a subject with a BMI over 30 and/or a waist circumference of greater than 102 cm in men or greater than 88 cm in women.

"Identifying" or "selecting a subject having dyslipidemia" means identifying or selecting a subject diagnosed with a disorder of lipid and/or lipoprotein metabolism, including lipid and/or lipoprotein overproduction or deficiency. Dyslipidemias may be manifested by elevation of lipids such as cholesterol and triglycerides as well as lipoproteins such as low-density lipoprotein (LDL) cholesterol.

"Identifying" or "selecting" a subject having increased adiposity" means identifying or selecting a subject having an increased amount of body fat (or adiposity) that includes concern for one or both the distribution of fat throughout the body and the size and mass of the adipose tissue deposits. Body fat distribution can be estimated by skin-fold measures, waist-to-hip circumference ratios, or techniques such as ultrasound, computer tomography, or magnetic resonance imaging. According to the Center for Disease Control and Prevention, individuals with a body mass index (BMI) of 30 or more are considered obese.

"Improved cardiovascular outcome" means a reduction in the occurrence of adverse cardiovascular events, or the risk thereof. Examples of adverse cardiovascular events include, without limitation, death, reinfarction, stroke, cardiogenic shock, pulmonary edema, cardiac arrest, and atrial dysrhythmia.

"Immediately adjacent" means there are no intervening elements between the immediately adjacent elements.

"Individual" or "subject" or "animal" means a human or non-human animal selected for treatment or therapy.

"Inhibiting the expression or activity" refers to a reduction or blockade of the expression or activity and does not necessarily indicate a total elimination of expression or activity.

"Insulin resistance" is defined as the condition in which normal amounts of insulin are inadequate to produce a normal insulin response from cells, e.g., fat, muscle and/or liver cells. Insulin resistance in fat cells results in hydrolysis of stored triglycerides, which elevates free fatty acids in the blood plasma. Insulin resistance in muscle reduces glucose uptake whereas insulin resistance in liver reduces glucose storage, with both effects serving to elevate blood glucose. High plasma levels of insulin and glucose due to insulin resistance often leads to metabolic syndrome and type 2 diabetes.

"Insulin sensitivity" is a measure of how effectively an individual processes glucose. An individual having high insulin sensitivity effectively processes glucose whereas an individual with low insulin sensitivity does not effectively process glucose.

"Internucleoside linkage" refers to the chemical bond between nucleosides.

"Intravenous administration" means administration into a vein.

"Linked nucleosides" means adjacent nucleosides which are bonded together.

"Lipid-lowering" means a reduction in one or more lipids in a subject. Lipid-lowering can occur with one or more doses over time.

"Lipid-lowering agent" means an agent, for example, an ANGPTL3-specific modulator, provided to a subject to achieve a lowering of lipids in the subject. For example, in certain embodiments, a lipid-lowering agent is provided to a subject to reduce one or more of apoB, apoC-III, total cholesterol, LDL-C, VLDL-C, IDL-C, non-HDL-C, triglycerides, small dense LDL particles, and Lp(a) in a subject.

"Lipid-lowering therapy" means a therapeutic regimen provided to a subject to reduce one or more lipids in a subject. In certain embodiments, a lipid-lowering therapy is provided to reduce one or more of apoB, apoC-III, total cholesterol, LDL-C, VLDL-C, IDL-C, non-HDL-C, triglycerides, small dense LDL particles, and Lp(a) in a subject.

"Lipoprotein", such as VLDL, LDL and HDL, refers to a group of proteins found in the serum, plasma and lymph and are important for lipid transport. The chemical composition of each lipoprotein differs in that the HDL has a higher proportion of protein versus lipid, whereas the VLDL has a lower proportion of protein versus lipid.

"Low density lipoprotein-cholesterol (LDL-C)" means cholesterol carried in low density lipoprotein particles. Concentration of LDL-C in serum (or plasma) is typically quantified in mg/dL or nmol/L. "Serum LDL-C" and "plasma LDL-C" mean LDL-C in the serum and plasma, respectively.

"Major risk factors" refers to factors that contribute to a high risk for a particular disease or condition. In certain embodiments, major risk factors for coronary heart disease include, without limitation, cigarette smoking, hypertension, low HDL-C, family history of coronary heart disease, age, and other factors disclosed herein.

"Metabolic disorder" or "metabolic disease" refers to a condition characterized by an alteration or disturbance in metabolic function. "Metabolic" and "metabolism" are terms well known in the art and generally include the whole range of biochemical processes that occur within a living organism. Metabolic disorders include, but are not limited to, hyperglycemia, prediabetes, diabetes (type I and type 2), obesity, insulin resistance, metabolic syndrome and dyslipidemia due to type 2 diabetes.

"Metabolic syndrome" means a condition characterized by a clustering of lipid and non-lipid cardiovascular risk factors of metabolic origin. In certain embodiments, metabolic syndrome is identified by the presence of any 3 of the following factors: waist circumference of greater than 102 cm in men or greater than 88 cm in women; serum triglyceride of at least 150 mg/dL; HDL-C less than 40 mg/dL in men or less than 50 mg/dL in women; blood pressure of at least 130/85 mmHg; and fasting glucose of at least 110 mg/dL. These determinants can be readily measured in clinical practice (JAMA, 2001, 285: 2486-2497).

"Mismatch" or "non-complementary nucleobase" refers to the case when a nucleobase of a first nucleic acid is not capable of pairing with the corresponding nucleobase of a second or target nucleic acid.

"Mixed dyslipidemia" means a condition characterized by elevated cholesterol and elevated triglycerides.

"Modified internucleoside linkage" refers to a substitution or any change from a naturally occurring internucleoside bond (i.e. a phosphodiester internucleoside bond).

"Modified nucleobase" refers to any nucleobase other than adenine, cytosine, guanine, thymidine, or uracil. An "unmodified nucleobase" means the purine bases adenine (A) and guanine (G), and the pyrimidine bases thymine (T), cytosine (C), and uracil (U).

"Modified nucleoside" means a nucleoside having, independently, one or more modified sugar moiety or modified nucleobase.

"Modified nucleotide" means a nucleotide having, independently, one or more modified sugar moiety, modified internucleoside linkage, or modified nucleobase. A "modified nucleoside" means a nucleoside having, independently, one or more modified sugar moiety or modified nucleobase.

"Modified oligonucleotide" means an oligonucleotide comprising at least one modified nucleotide.

"Modified sugar" refers to a substitution or change from a natural sugar.

"Motif" means the pattern of chemically distinct regions in an antisense compound.

"MTP inhibitor" means an agent inhibits the enzyme microsomal triglyceride transfer protein.

"Naturally occurring internucleoside linkage" means a 3' to 5' phosphodiester linkage.

"Natural sugar moiety" means a sugar found in DNA (2'-H) or RNA (2'-OH).

"Non-alcoholic fatty liver disease" or "NAFLD" means a condition characterized by fatty inflammation of the liver that is not due to excessive alcohol use (for example, alcohol consumption of over 20 g/day). In certain embodiments, NAFLD is related to insulin resistance and metabolic syndrome. NAFLD encompasses a disease spectrum ranging from simple triglyceride accumulation in hepatocytes (hepatic steatosis) to hepatic steatosis with inflammation (steatohepatitis), fibrosis, and cirrhosis.

"Nonalcoholic steatohepatitis" (NASH) occurs from progression of NAFLD beyond deposition of triglycerides. A "second hit" capable of inducing necrosis, inflammation, and fibrosis is required for development of NASH. Candidates for the second-hit can be grouped into broad categories: factors causing an increase in oxidative stress and factors promoting expression of proinflammatory cytokines. It has been suggested that increased liver triglycerides lead to increased oxidative stress in hepatocytes of animals and humans, indicating a potential cause-and-effect relationship between hepatic triglyceride accumulation, oxidative stress, and the progression of hepatic steatosis to NASH (Browning and Horton, *J Clin Invest,* 2004, 114, 147-152). Hypertriglyceridemia and hyperfattyacidemia can cause triglyceride accumulation in peripheral tissues (Shimamura et al., *Biochem Biophys Res Commun,* 2004, 322, 1080-1085).

"Nucleic acid" refers to molecules composed of monomeric nucleotides. A nucleic acid includes ribonucleic acids (RNA), deoxyribonucleic acids (DNA), single-stranded nucleic acids, double-stranded nucleic acids, small interfering ribonucleic acids (siRNA), and microRNAs (miRNA). A nucleic acid can also comprise a combination of these elements in a single molecule.

"Nucleobase" means a heterocyclic moiety capable of pairing with a base of another nucleic acid.

"Nucleobase sequence" means the order of contiguous nucleobases independent of any sugar, linkage, or nucleobase modification.

"Nucleoside" means a nucleobase linked to a sugar.

"Nucleoside mimetic" includes those structures used to replace the sugar or the sugar and the base and not necessarily the linkage at one or more positions of an oligomeric compound such as for example nucleoside mimetics having morpholino, cyclohexenyl, cyclohexyl, tetrahydropyranyl, bicyclo or tricyclo sugar mimetics e.g. non furanose sugar units.

"Nucleotide" means a nucleoside having a phosphate group covalently linked to the sugar portion of the nucleoside.

"Nucleotide mimetic" includes those structures used to replace the nucleoside and the linkage at one or more positions of an oligomeric compound such as for example peptide nucleic acids or morpholinos (morpholinos linked by —N(H)—C(=O)—O— or other non-phosphodiester linkage).

"Oligomeric compound" or "oligomer" refers to a polymeric structure comprising two or more sub-structures and capable of hybridizing to a region of a nucleic acid molecule. In certain embodiments, oligomeric compounds are oligonucleosides. In certain embodiments, oligomeric compounds are oligonucleotides. In certain embodiments, oligomeric compounds are antisense compounds. In certain embodiments, oligomeric compounds are antisense oligonucleotides. In certain embodiments, oligomeric compounds are chimeric oligonucleotides.

"Oligonucleotide" means a polymer of linked nucleosides each of which can be modified or unmodified, independent one from another.

"Parenteral administration" means administration by a manner other than through the digestive tract. Parenteral administration includes topical administration, subcutaneous administration, intravenous administration, intramuscular administration, intraarterial administration, intraperitoneal administration, or intracranial administration, e.g. intrathecal or intracerebroventricular administration. Administration can be continuous, or chronic, or short or intermittent.

"Peptide" means a molecule formed by linking at least two amino acids by amide bonds. Peptide refers to polypeptides and proteins.

"Pharmaceutical agent" means a substance that provides a therapeutic benefit when administered to an individual. For example, in certain embodiments, an antisense oligonucleotide targeted to ANGPTL3 is pharmaceutical agent.

"Pharmaceutical composition" means a mixture of substances suitable for administering to an individual. For example, a pharmaceutical composition can comprise one or more active agents and a sterile aqueous solution.

"Pharmaceutically acceptable carrier" means a medium or diluent that does not interfere with the structure or function of the oligonucleotide. Certain, of such carries enable pharmaceutical compositions to be formulated as, for example, tablets, pills, dragees, capsules, liquids, gels, syrups, slurries, suspension and lozenges for the oral ingestion by a subject. Certain of such carriers enable pharmaceutical compositions to be formulated for injection or infusion. For example, a pharmaceutically acceptable carrier can be a sterile aqueous solution.

"Pharmaceutically acceptable salts" means physiologically and pharmaceutically acceptable salts of antisense compounds, i.e., salts that retain the desired biological activity of the parent oligonucleotide and do not impart undesired toxicological effects thereto.

"Phosphorothioate linkage" means a linkage between nucleosides where the phosphodiester bond is modified by replacing one of the non-bridging oxygen atoms with a sulfur atom. A phosphorothioate linkage is a modified internucleoside linkage.

"Portion" means a defined number of contiguous (i.e. linked) nucleobases of a nucleic acid. In certain embodiments, a portion is a defined number of contiguous nucleobases of a target nucleic acid. In certain embodiments, a portion is a defined number of contiguous nucleobases of an antisense compound.

"Prevent" refers to delaying or forestalling the onset or development of a disease, disorder, or condition for a period of time from minutes to indefinitely. Prevent also means reducing risk of developing a disease, disorder, or condition.

"Prodrug" means a therapeutic agent that is prepared in an inactive form that is converted to an active form within the body or cells thereof by the action of endogenous enzymes or other chemicals or conditions.

"Side effects" means physiological responses attributable to a treatment other than the desired effects. In certain embodiments, side effects include injection site reactions, liver function test abnormalities, renal function abnormalities, liver toxicity, renal toxicity, central nervous system abnormalities, myopathies, and malaise. For example, increased aminotransferase levels in serum can indicate liver toxicity or liver function abnormality. For example, increased bilirubin can indicate liver toxicity or liver function abnormality.

"Single-stranded oligonucleotide" means an oligonucleotide which is not hybridized to a complementary strand.

"Specifically hybridizable" refers to an antisense compound having a sufficient degree of complementarity with a target nucleic acid to induce a desired effect, while exhibiting minimal or no effects on non-target nucleic acids under conditions in which specific binding is desired, i.e. under physiological conditions in the case of in vivo assays and therapeutic treatments.

"Statin" means an agent that inhibits the activity of HMG-CoA reductase.

"Subcutaneous administration" means administration just below the skin.

"Targeting" or "targeted" means the process of design and selection of an antisense compound that will specifically hybridize to a target nucleic acid and induce a desired effect.

"Target nucleic acid," "target RNA," and "target RNA transcript" all refer to a nucleic acid capable of being targeted by antisense compounds.

"Target region" is defined as a portion of the target nucleic acid having at least one identifiable structure, function, or characteristic.

"Target segment" means the sequence of nucleotides of a target nucleic acid to which one or more antisense compound is targeted. "5' target site" or "5' start site" refers to the 5'-most nucleotide of a target segment. "3' target site" or "3' stop site" refers to the 3'-most nucleotide of a target segment.

"Therapeutically effective amount" means an amount of an agent that provides a therapeutic benefit to an individual.

"Therapeutic lifestyle change" means dietary and lifestyle changes intended to lower fat/adipose tissue mass and/or cholesterol. Such change can reduce the risk of developing heart disease, and may include recommendations for dietary intake of total daily calories, total fat, saturated fat, polyunsaturated fat, monounsaturated fat, carbohydrate, protein, cholesterol, insoluble fiber, as well as recommendations for physical activity.

"Triglyceride" means a lipid or neutral fat consisting of glycerol combined with three fatty acid molecules.

"Type 2 diabetes" (also known as "type 2 diabetes mellitus" or "diabetes mellitus, type 2", and formerly called "diabetes mellitus type 2", "non-insulin-dependent diabetes (NIDDM)", "obesity related diabetes", or "adult-onset diabetes") is a metabolic disorder that is primarily characterized by insulin resistance, relative insulin deficiency, and hyperglycemia.

"Treat" refers to administering a pharmaceutical composition to effect an alteration or improvement of a disease, disorder, or condition.

"Unmodified nucleotide" means a nucleotide composed of naturally occurring nucleobases, sugar moieties, and internucleoside linkages. In certain embodiments, an unmodified nucleotide is a RNA nucleotide (i.e. β-D-ribonucleosides) or a DNA nucleotide (i.e. β-D-deoxyribonucleoside).

CERTAIN EMBODIMENTS

In certain embodiments disclosed herein, ANGPTL3 has the sequence as set forth in GenBank Accession No. NM_014495.2 (incorporated herein as SEQ ID NO: 1). In certain embodiments, ANGPTL3 has the sequence as set forth in GenBank Accession No. NT_032977.9 nucleotides 33032001 to 33046000 (incorporated herein as SEQ ID NO: 2).

Certain embodiments disclosed herein provide compounds or compositions comprising a modified oligonucleotide consisting of 12 to 30 nucleosides having a nucleobase sequence comprising at least 8 contiguous nucleobases complementary to an equal length portion of SEQ ID NOs: 1-2.

Certain embodiments disclosed herein provide compounds or compositions comprising a modified oligonucleotide 12 to 30 linked nucleosides in length targeted to ANGPTL3. The ANGPTL target can have a sequence selected from any one of SEQ ID NOs: 1-2.

Certain embodiments disclosed herein provide compounds or compositions comprising a modified oligonucleotide consisting of 12 to 30 linked nucleosides and comprising a nucleobase sequence comprising a portion of at least 8 contiguous nucleobases complementary to an equal length portion of nucleobases 1140 to 1159 of SEQ ID NO: 1, wherein the nucleobase sequence of the modified oligonucleotide is at least 80% complementary to SEQ ID NO: 1. In certain embodiments, the modified oligonucleotide is at least 8, least 9, least 10, least 11, at least 12, least 13, at least 14, at least 15, at least 16, least 17, least 18, least 19, or 20 contiguous nucleobases complementary to an equal length portion of nucleobases 1140 to 1159 of SEQ ID NO: 1.

Certain embodiments disclosed herein provide compounds or compositions comprising a modified oligonucleotide consisting of 12 to 30 linked nucleosides and comprising a nucleobase sequence complementary to nucleobases 1140 to 1159 of SEQ ID NO: 1, wherein the nucleobase sequence of the modified oligonucleotide is at least 80% complementary to SEQ ID NO: 1.

Certain embodiments disclosed herein provide compounds or compositions comprising a modified oligonucleotide consisting of 12 to 30 linked nucleosides and comprising a nucleobase sequence comprising a portion of at least 8 contiguous nucleobases complementary to an equal length portion of nucleobases 1907 to 1926 of SEQ ID NO: 1, wherein the nucleobase sequence of the modified oligonucleotide is at least 80% complementary to SEQ ID NO: 1. In certain embodiments, the modified oligonucleotide is at least 8, least 9, least 10, least 11, at least 12, least 13, at least 14, at least 15, at least 16, least 17, least 18, least 19, or 20 contiguous nucleobases complementary to an equal length portion of nucleobases 1907 to 1926 of SEQ ID NO: 1.

Certain embodiments disclosed herein provide compounds or compositions comprising a modified oligonucleotide consisting of 12 to 30 linked nucleosides and comprising a nucleobase sequence complementary to nucleobases 1907 to 1926 of SEQ ID NO: 1, wherein the nucleobase sequence of the modified oligonucleotide is at least 80% complementary to SEQ ID NO: 1.

Certain embodiments disclosed herein provide compounds or compositions comprising a modified oligonucleotide consisting of 12 to 30 linked nucleosides and comprising a nucleobase sequence comprising a portion of at least 8 contiguous nucleobases complementary to an equal length portion of nucleobases 147 to 162 of SEQ ID NO: 1, wherein the nucleobase sequence of the modified oligonucleotide is at least 80% complementary to SEQ ID NO: 1. In certain embodiments, the modified oligonucleotide is at least 8, least 9, least 10, least 11, at least 12, least 13, at least 14, at least 15, or 16 contiguous nucleobases complementary to an equal length portion of nucleobases 147 to 162 of SEQ ID NO: 1.

Certain embodiments disclosed herein provide compounds or compositions comprising a modified oligonucleotide consisting of 12 to 30 linked nucleosides and comprising a nucleobase sequence complementary to nucleobases 147 to 162 of SEQ ID NO: 1, wherein the nucleobase sequence of the modified oligonucleotide is at least 80% complementary to SEQ ID NO: 1.

In certain embodiments, the modified oligonucleotide consists of 12 to 30, 15 to 30, 18 to 24, 19 to 22, 13 to 25, 14 to 25, 15 to 25 or 16 to 24 linked nucleosides. In certain embodiments, the modified oligonucleotide consists of 8, 9, 10, 11, 12, 13, 14, 15, 16, 17, 18, 19, 20, 21, 22, 23, 24, 25, 26, 27, 28, 29 or 30 linked nucleosides or a range defined by any two of these values. In certain embodiments, the modified oligonucleotide is 16 linked nucleosides in length. In certain embodiments, the modified oligonucleotide is 20 linked nucleosides in length.

In certain embodiments, the modified oligonucleotide comprises a nucleobase sequence comprising a portion of at least 8, least 9, least 10, least 11, at least 12, least 13, at least 14, at least 15, at least 16, least 17, least 18, least 19, or 20 contiguous nucleobases complementary to an equal length portion of SEQ ID NO: 1 or 2.

Certain embodiments disclosed herein provide compounds or compositions comprising a modified oligonucleotide consisting of 12 to 30 linked nucleosides and having a nucleobase sequence comprising at least 8, least 9, least 10, least 11, at least 12, least 13, at least 14, at least 15, at least 16, least 17, least 18, least 19, or 20 contiguous nucleobases of a nucleobase sequence selected from any one of SEQ ID NOs: 15-27, 30-73, 75-85, 87-232, 238, 240-243, 245-247, 249-262, 264-397, 399-469, 471-541, 543-600, 604-760, 762-819, 821-966, 968-971, 973-975, 977-990, 992-1110, 1112-1186, 1188-1216, 1218-1226, 1228-1279, 1281-1293, 1295-1304, 1306-1943, 1945-1951, 1953-1977, 1979-1981, 1983-2044, 2046-2097, 2099-2181, 2183-2232, 2234-2238, 2240-2258, 2260-2265, 2267-2971, 2973-2976, 2978-4162, 4164-4329, 4331-4389, 4391-4394, 4396-4877.

Certain embodiments disclosed herein provide compounds or compositions comprising a modified oligonucleotide consisting of 12 to 30 linked nucleosides and having a nucleobase sequence comprising at least 8, least 9, least 10, least 11, at least 12, least 13, at least 14, at least 15, at least 16, least 17, least 18, least 19, or 20 contiguous nucleobases of the nucleobase sequences of SEQ ID NOs: 77.

Certain embodiments disclosed herein provide compounds or compositions comprising a modified oligonucleotide consisting of 12 to 30 linked nucleosides and having a nucleobase sequence comprising at least 8, least 9, least 10, least 11, at least 12, least 13, at least 14, at least 15, at least 16, least 17, least 18, least 19, or 20 contiguous nucleobases of the nucleobase sequence of SEQ ID NO: 20.

Certain embodiments disclosed herein provide compounds or compositions comprising a modified oligonucleotide consisting of 12 to 30 linked nucleosides and having a nucleobase sequence comprising at least 8, least 9, least 10, least 11, at least 12, least 13, at least 14, at least 15, or 16 contiguous nucleobases of the nucleobase sequence of SEQ ID NO: 110.

In certain embodiments, the nucleobase sequence of the modified oligonucleotide is at least 70%, 75%, 80%, 85%, 90%, 95% or 100% complementary to any one of SEQ ID NO: 1-2 as measured over the entirety of the modified oligonucleotide.

In certain embodiments, the compound disclosed herein is a single-stranded oligonucleotide. In certain embodiments, the compound disclosed herein is a single-stranded modified oligonucleotide.

In certain embodiments, at least one internucleoside linkage of said modified oligonucleotide is a modified internucleoside linkage. In certain embodiments, each internucleoside linkage is a phosphorothioate internucleoside linkage.

In certain embodiments, at least one nucleoside of the modified oligonucleotide comprises a modified sugar. In certain embodiments, at least one modified sugar is a bicyclic sugar. In certain embodiments, at least one modified sugar comprises a 2'-O-methoxyethyl, a constrained ethyl, a 3'-fluoro-HNA or a 4'-(CH$_2$)$_n$—O-2' bridge, wherein n is 1 or 2.

In certain embodiments, at least one nucleoside of said modified oligonucleotide comprises a modified nucleobase. In certain embodiments, the modified nucleobase is a 5-methylcytosine.

Certain embodiments disclosed herein provide compounds or compositions comprising a modified oligonucleotide with: a) a gap segment consisting of linked deoxynucleosides; b) a 5' wing segment consisting of linked nucleosides; and c) a 3' wing segment consisting of linked nucleosides. The gap segment is positioned between the 5' wing segment and the 3' wing segment and each nucleoside of each wing segment comprises a modified sugar.

In certain embodiments, the modified oligonucleotide consists of 12 to 30 linked nucleosides and comprises: a gap segment consisting of linked deoxynucleosides; a 5' wing segment consisting of linked nucleosides; a 3' wing segment consisting of linked nucleosides; wherein the gap segment is positioned between the 5' wing segment and the 3' wing segment and wherein each nucleoside of each wing segment comprises a modified sugar.

In certain embodiments, the compounds or compositions disclosed herein comprise a modified oligonucleotide consisting of 20 linked nucleosides having a nucleobase sequence comprising at least 8 contiguous nucleobases complementary to an equal length portion of SEQ ID NO: 1-2, wherein the modified oligonucleotide comprises: a gap segment consisting of ten linked deoxynucleosides; a 5' wing segment consisting of five linked nucleosides; and a 3' wing segment consisting of five linked nucleosides; wherein the gap segment is positioned between the 5' wing segment and the 3' wing segment; wherein each nucleoside of each wing segment comprises a 2'-O-methoxyethyl sugar; wherein each internucleoside linkage is a phosphorothioate linkage and wherein each cytosine residue is a 5-methylcytosine.

In certain embodiments, the modified oligonucleotide consists of 20 linked nucleosides and comprises: a gap segment consisting of ten linked deoxynucleosides; a 5' wing segment consisting of five linked nucleosides; a 3' wing segment consisting of five linked nucleosides; wherein the gap segment is positioned between the 5' wing segment and the 3' wing segment; wherein each nucleoside of each wing segment comprises a 2'-O-methoxyethyl sugar; wherein each internucleoside linkage is a phosphorothioate linkage and wherein each cytosine residue is a 5-methylcytosine.

In certain embodiments, the compounds or compositions disclosed herein comprise a modified oligonucleotide consisting of 20 linked nucleosides having a nucleobase sequence comprising at least 8 contiguous nucleobases of a nucleobase sequence selected of SEQ ID NO: 77, wherein the modified oligonucleotide comprises: a gap segment consisting of ten linked deoxynucleosides; a 5' wing segment consisting of five linked nucleosides; and a 3' wing segment consisting of five linked nucleosides; wherein the gap segment is positioned between the 5' wing segment and the 3' wing segment; wherein each nucleoside of each wing segment comprises a 2'-O-methoxyethyl sugar; wherein each internucleoside linkage is a phosphorothioate linkage and wherein each cytosine residue is a 5-methylcytosine.

In certain embodiments, the modified oligonucleotide consists of 20 linked nucleosides with the nucleobase sequence of SEQ ID NO: 77 and comprises: a gap segment consisting of ten linked deoxynucleosides; a 5' wing segment consisting of five linked nucleosides; a 3' wing segment consisting of five linked nucleosides; wherein the gap segment is positioned between the 5' wing segment and the 3' wing segment; wherein each nucleoside of each wing segment comprises a 2'-O-methoxyethyl sugar; wherein each internucleoside linkage is a phosphorothioate linkage and wherein each cytosine residue is a 5-methylcytosine.

In certain embodiments, the modified oligonucleotide is ISIS 563580. In certain embodiments, ISIS 563580 is characterized as a 5-10-5 MOE gapmer, having a sequence of (from 5' to 3') GGACATTGCCAGTAATCGCA (incorporated herein as SEQ ID NO: 77), wherein each internucleoside linkage is a phosphorothioate linkage, each cytosine is a 5'-methylcytosine, each of nucleosides 1-5 and 16-20 are 2'-O-methoxyethyl modified nucleosides, and each of nucleosides 6-15 are 2'-deoxynucleosides.

In certain embodiments, ISIS 563580 is described by the following chemical notation having SEQ ID NO: 77: Ges Ges Aes mCes Aes Tds Tds Gds mCds mCds Ads Gds Tds Ads Ads Tes mCes Ges mCes Ae; wherein, A=an adenine,
mC=a 5'-methylcytosine
G=a guanine,
T=a thymine,
e=a 2'-O-methoxyethyl modified nucleoside,
d=a 2'-deoxynucleoside, and
s=a phosphorothioate internucleoside linkage.

In certain embodiments, ISIS 563580 is described by the following chemical structure having SEQ ID NO: 77:

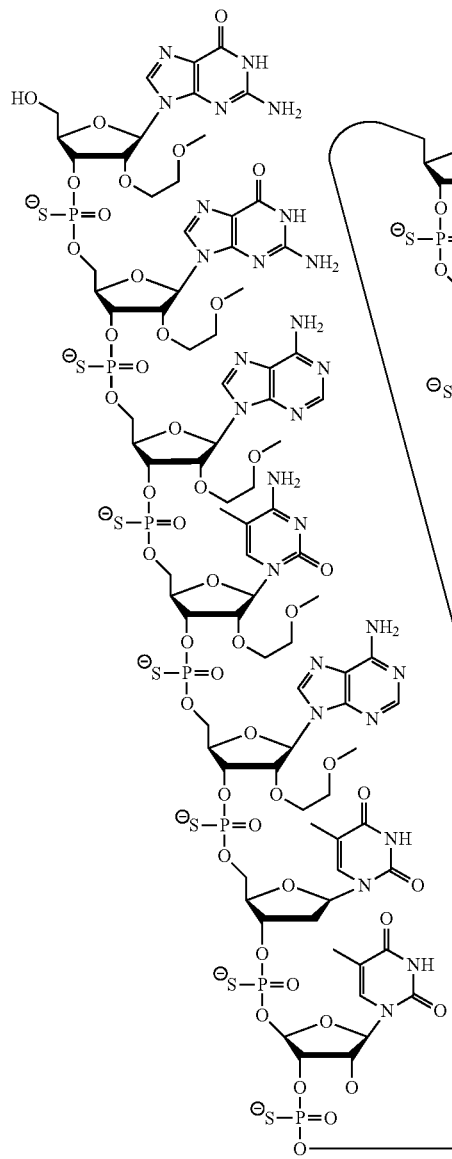
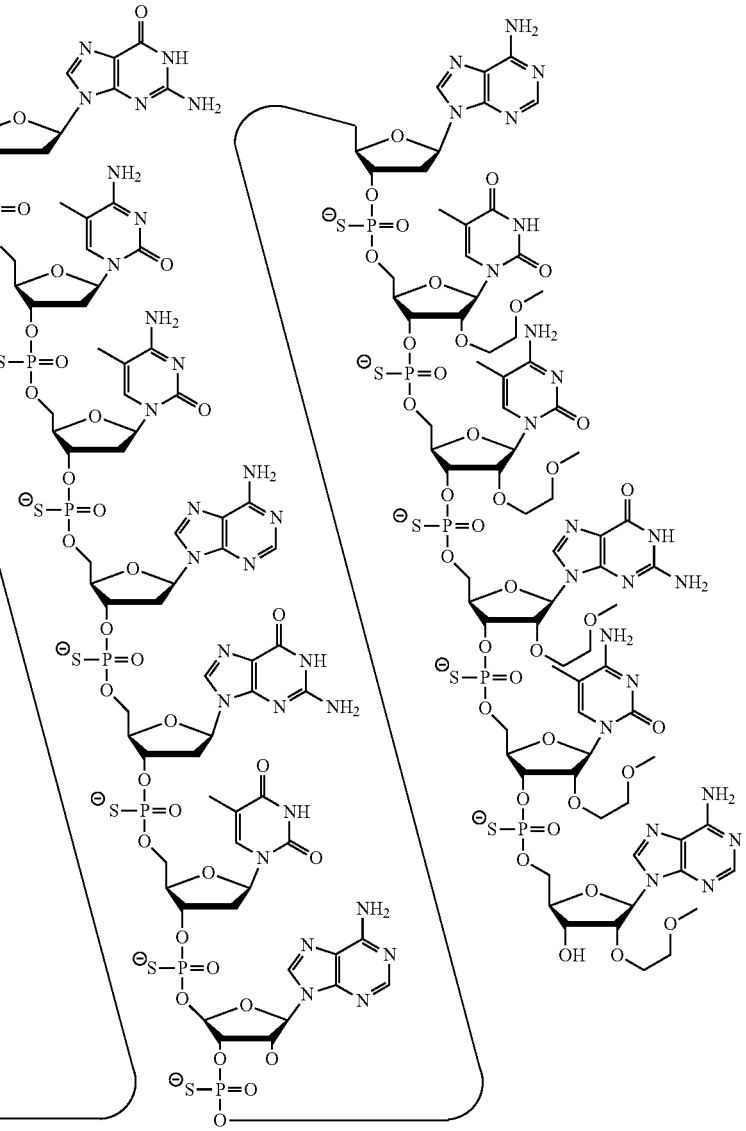

In certain embodiments, the modified oligonucleotide comprises ISIS 563580 represented by the preceeding chemical structure.

In certain embodiments, the compounds or compositions disclosed herein comprise a modified oligonucleotide consisting of 20 linked nucleosides having a nucleobase sequence comprising at least 8 contiguous nucleobases of a nucleobase sequence selected of SEQ ID NO: 20, wherein the modified oligonucleotide comprises: a gap segment consisting of ten linked deoxynucleosides; a 5' wing segment consisting of five linked nucleosides; and a 3' wing segment consisting of five linked nucleosides; wherein the gap segment is positioned between the 5' wing segment and the 3' wing segment; wherein each nucleoside of each wing segment comprises a 2'-O-methoxyethyl sugar; wherein each internucleoside linkage is a phosphorothioate linkage and wherein each cytosine residue is a 5-methylcytosine.

In certain embodiments, the modified oligonucleotide consists of 20 linked nucleosides with the nucleobase sequence of SEQ ID NO: 20 and comprises: a gap segment consisting of ten linked deoxynucleosides; a 5' wing segment consisting of five linked nucleosides; a 3' wing segment consisting of five linked nucleosides; wherein the gap segment is positioned between the 5' wing segment and the 3' wing segment; wherein each nucleoside of each wing segment comprises a 2'-O-methoxyethyl sugar; wherein each internucleoside linkage is a phosphorothioate linkage and wherein each cytosine residue is a 5-methylcytosine.

In certain embodiments, the compounds or compositions disclosed herein comprise a modified oligonucleotide consisting of 16 linked nucleosides having a nucleobase sequence comprising at least 8 contiguous nucleobases of a nucleobase sequence of SEQ ID NO: 110, wherein the modified oligonucleotide comprises: a gap segment consisting of ten linked deoxynucleosides; a 5' wing segment consisting of three linked nucleosides; and a 3' wing segment consisting of three linked nucleosides; wherein the gap segment is positioned between the 5' wing segment and the 3' wing segment; wherein each wing segment comprises at least one 2'-O-methoxyethyl sugar and at least one cEt sugar; wherein each internucleoside linkage is a phosphorothioate linkage and wherein each cytosine residue is a 5-methylcytosine.

In certain embodiments, the modified oligonucleotide consists of 16 linked nucleosides with the nucleobase sequence of SEQ ID NO: 110 and comprises: a gap segment consisting of ten linked deoxynucleosides; a 5' wing segment consisting of three linked nucleosides; a 3' wing segment consisting of three linked nucleosides; wherein the gap segment is positioned between the 5' wing segment and the 3' wing segment; wherein each wing segment comprises at least one 2'-O-methoxyethyl sugar and at least one cEt sugar; wherein each internucleoside linkage is a phosphorothioate linkage and wherein each cytosine residue is a 5-methylcytosine.

Certain embodiments provide methods of using the compounds and compositions described herein for inhibiting ANGPTL3 expression. In certain embodiments, the compounds or compositions inhibit ANGPTL3 by at least 5%, at least 10%, at least 20%, at least 30%, at least 35%, at least 40%, at least 45%, at least 50%, at least 55%, at least 60%, at least 65%, at least 70%, at least 75%, at least 80%, at least 85%, at least 90% or at least 95%. In a preferred embodiment, the antisense compound comprising a modified oligonucleotide decreases ANGPTL3 by at least 50%. In a preferred embodiment, the antisense compound comprising a modified oligonucleotide decreases ANGPTL3 by at least 55%. In a preferred embodiment the antisense compound comprising a modified oligonucleotide decreases ANGPTL3 by at least 60%. In a preferred embodiment, the antisense compound comprising a modified oligonucleotide decreases ANGPTL3 by at least 65%. In a preferred embodiment, the antisense compound comprising a modified oligonucleotide decreases ANGPTL3 by at least 70%. In a preferred embodiment, the antisense compound comprising a modified oligonucleotide decreases ANGPTL3 by at least 75%. In a preferred embodiment, the antisense compound comprising a modified oligonucleotide decreases ANGPTL3 by at least 80%. In a preferred embodiment, the antisense compound comprising a modified oligonucleotide decreases ANGPTL3 by at least 85%. In a preferred embodiment, the antisense compound comprising a modified oligonucleotide decreases ANGPTL3 by at least 90%. In a preferred embodiment, the antisense compound comprising a modified oligonucleotide decreases ANGPTL3 by at least 95%.

Certain embodiments provide methods of using the compounds and compositions described herein for reducing one or more of triglycerides, LDL-cholesterol, non-HDL cholesterol, VLDL-cholesterol, total cholesterol, ApoB and ApoC-III. In certain embodiments, the compounds or compositions reduce one or more of triglycerides, LDL-cholesterol, non-HDL cholesterol, VLDL-cholesterol, total cholesterol, ApoB and ApoC-III by at least 5%, at least 10%, at least 20%, at least 30%, at least 35%, at least 40%, at least 45%, at least 50%, at least 55%, at least 60%, at least 65%, at least 70%, at least 75%, at least 80%, at least 85%, at least 90% or at least 95%.

In certain embodiments, the compounds or compositions disclosed herein have an $IC_{50}$ of less than 20 Ian less than 10 µM, an less than 8 µM, less than 5 µM, less than 2 µM, less than 1 µM, or less than 0.8 µM, when tested human cells, for example, in the Hep3B cell line as described in Examples 2-3 and 7-10.

In certain embodiments, the compounds or compositions disclosed herein are efficacious by virtue of having a viscosity of less than 40 cP, less than 35 cP, less than 30 cP, less than 25 cP, less than 20 cP or less than 15 cP when measured by the parameters as described in Example 13.

In certain embodiments, the compounds or compositions disclosed herein are highly tolerable, as demonstrated by the in vivo tolerability measurements described in the examples. In certain embodiments, the antisense compounds as described herein are highly tolerable, as demonstrated by having an increase in ALT and/or AST value of no more than 4 fold, 3 fold, 2 fold or 1.5 fold over saline treated animals.

In certain embodiments, the compounds or compositions disclosed herein comprise a salt of the modified oligonucleotide.

In certain embodiments, the compounds or compositions disclosed herein further comprise a pharmaceutically acceptable carrier or diluent.

In certain embodiments, the animal is a human.

Certain embodiments provide methods of using the compounds and compositions described herein in therapy. In certain embodiments, the therapy is used in treating, preventing, or slowing progression of a disease related to elevated ANGPTL3. In certain embodiments, the disease is a cardiovascular and/or metabolic disease, disorder or condition. In certain embodiments, the metabolic and/or cardiovascular disease includes, but is not limited to, obesity, diabetes, atherosclerosis, dyslipidemia, lipodystrophy, coronary heart disease, non-alcoholic fatty liver disease (NAFLD), nonalcoholic steatohepatitis (NASH) hyperfattyacidemia or metabolic syndrome, or a combination thereof. The dyslipidemia can be hyperlipidemia. The hyperlipidemia can be combined hyperlipidemia, familial combined hyperlipidemia (FCHL), hypercholesterolemia, hypertriglyceridemia, or both hypercholesterolemia and hypertriglyceridemia. The hypercholesterolemia can be familial homozygous hypercholesterolemia (HoFH), familial heterozygous hypercholesterolemia (HeFH). The hypertriglyceridemia can be familial chylomicronemia syndrome (FCS) or hyperlipoproteinemia Type IV. The NAFLD can be hepatic steatosis or steatohepatitis. The diabetes can be type 2 diabetes or type 2 diabetes with dyslipidemia.

In certain embodiments, the compounds or compositions disclosed herein are designated as a first agent and the methods or uses disclosed herein further comprise administering a second agent. In certain embodiments, the first agent and the second agent are co-administered. In certain embodiments the first agent and the second agent are co-administered sequentially or concomitantly.

In certain embodiments, the second agent is a glucose-lowering agent. The glucose lowering agent can include, but is not limited to, a therapeutic lifestyle change, PPAR agonist, a dipeptidyl peptidase (IV) inhibitor, a GLP-1 analog, insulin or an insulin analog, an insulin secretagogue, a SGLT2 inhibitor, a human amylin analog, a biguanide, an alpha-glucosidase inhibitor, or a combination thereof. The glucose-lowering agent can include, but is not limited to metformin, sulfonylurea, rosiglitazone, meglitinide, thiazolidinedione, alpha-glucosidase inhibitor or a combination thereof. The sulfonylurea can be acetohexamide, chlorpropamide, tolbutamide, tolazamide, glimepiride, a glipizide, a glyburide, or a gliclazide. The meglitinide can be nateglinide or repaglinide. The thiazolidinedione can be pioglitazone or rosiglitazone. The alpha-glucosidase can be acarbose or miglitol.

In certain embodiments, the second agent is a lipid-lowering therapy. In certain embodiments the lipid lowering therapy can include, but is not limited to, a therapeutic lifestyle change, HMG-CoA reductase inhibitor, cholesterol absorption inhibitor, MTP inhibitor (e.g., a small molecule, polypeptide, antibody or antisense compound targeted to MTP), ApoB inhibitor (e.g., a small molecule, polypeptide, antibody or antisense compound targeted to ApoB), ApoC3 inhibitor (e.g., a small molecule, polypeptide, antibody or antisense compound targeted to ApoC3), PCSK9 inhibitor (e.g., a small molecule, polypeptide, antibody or antisense compound targeted to PCSK9), CETP inhibitor (e.g., a small molecule, polypeptide, antibody or antisense compound targeted to CETP), fibrate, beneficial oil (e.g., krill or fish oils (e.g., Vascepa®), flaxseed oil, or other oils rich in omega-3 fatty acids such as α-linolenic acid (ALA), docosahexaenoic acid (DHA) or eicosapentaenoic acid (EPA)), or any combination thereof. The HMG-CoA reductase inhibitor can be atorvastatin, rosuvastatin, fluvastatin, lovastatin, pravastatin, or simvastatin. The cholesterol absorption inhibitor can be ezetimibe. The fibrate can be fenofibrate, bezafibrate, ciprofibrate, clofibrate, gemfibrozil and the like.

In certain embodiments, administration comprises parenteral administration.

In certain embodiments, administering a compound disclosed herein results in a reduction of lipid levels, including triglyceride levels, cholesterol levels, insulin resistance, glucose levels or a combination thereof. One or more of the levels can be independently reduced by at least 5%, at least 10%, at least 20%, at least 30%, at least 35%, at least 40%, at least 45%, at least 50%, at least 55%, at least 60%, at least 65%, at least 70%, at least 75%, at least 80%, at least 85%, at least 90% or at least 95%. Administering the compound can result in improved insulin sensitivity or hepatic insulin sensitivity. Administering the compound disclosed herein can result in a reduction in atherosclerotic plaques, obesity, glucose, lipids, glucose resistance, cholesterol, or improvement in insulin sensitivity or any combination thereof.

Certain embodiments provide the use of a compound as described herein in the manufacture of a medicament for treating, ameliorating, delaying or preventing one or more of a metabolic disease or a cardiovascular disease.

Certain embodiments provide a kit for treating, preventing, or ameliorating one or more of a metabolic disease or a cardiovascular disease as described herein wherein the kit comprises: a) a compound as described herein; and optionally b) an additional agent or therapy as described herein. The kit can further include instructions or a label for using the kit to treat, prevent, or ameliorate one or more of a metabolic disease or a cardiovascular disease.

Antisense Compounds

Oligomeric compounds include, but are not limited to, oligonucleotides, oligonucleosides, oligonucleotide analogs, oligonucleotide mimetics, antisense compounds, antisense oligonucleotides, and siRNAs. An oligomeric compound can be "antisense" to a target nucleic acid, meaning that is capable of undergoing hybridization to a target nucleic acid through hydrogen bonding.

In certain embodiments, an antisense compound has a nucleobase sequence that, when written in the 5' to 3' direction, comprises the reverse complement of the target segment of a target nucleic acid to which it is targeted. In certain such embodiments, an antisense oligonucleotide has a nucleobase sequence that, when written in the 5' to 3' direction, comprises the reverse complement of the target segment of a target nucleic acid to which it is targeted.

In certain embodiments, an antisense compound targeted to ANGPTL3 nucleic acid is 10 to 30 nucleotides in length. In other words, antisense compounds are from 10 to 30 linked nucleobases. In other embodiments, the antisense compound comprises a modified oligonucleotide consisting of 8 to 80, 10 to 80, 12 to 50, 12 to 30, 15 to 30, 18 to 24, 19 to 22, or 20 linked nucleobases. In certain such embodiments, the antisense compound comprises a modified oligonucleotide consisting of 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 linked nucleobases in length, or a range defined by any two of the above values.

In certain embodiments, the antisense compound comprises a shortened or truncated modified oligonucleotide. The shortened or truncated modified oligonucleotide can have a single nucleoside deleted from the 5' end (5' truncation), or alternatively from the 3' end (3' truncation). A shortened or truncated oligonucleotide can have two or more nucleosides deleted from the 5' end, or alternatively can have two or more nucleosides deleted from the 3' end. Alternatively, the deleted nucleosides can be dispersed throughout the modified oligonucleotide, for example, in an antisense compound having one or more nucleoside deleted from the 5' end and one or more nucleoside deleted from the 3' end.

When a single additional nucleoside is present in a lengthened oligonucleotide, the additional nucleoside can be located at the 5', 3' end or central portion of the oligonucleotide. When two or more additional nucleosides are present, the added nucleosides can be adjacent to each other, for example, in an oligonucleotide having two nucleosides added to the 5' end (5' addition), or alternatively to the 3' end (3' addition) or the central portion, of the oligonucleotide. Alternatively, the added nucleoside can be dispersed throughout the antisense compound, for example, in an oligonucleotide having one or more nucleoside added to the 5' end, one or more nucleoside added to the 3' end, and/or one or more nucleoside added to the central portion.

It is possible to increase or decrease the length of an antisense compound, such as an antisense oligonucleotide, and/or introduce mismatch bases without eliminating activity. For example, in Woolf et al. (Proc. Natl. Acad. Sci. USA 89:7305-7309, 1992), a series of antisense oligonucleotides 13-25 nucleobases in length were tested for their ability to induce cleavage of a target RNA in an oocyte injection model. Antisense oligonucleotides 25 nucleobases in length with 8 or 11 mismatch bases near the ends of the antisense oligonucleotides were able to direct specific cleavage of the target mRNA, albeit to a lesser extent than the antisense oligonucleotides that contained no mismatches. Similarly, target specific cleavage was achieved using 13 nucleobase antisense oligonucleotides, including those with 1 or 3 mismatches.

Gautschi et al (J. Natl. Cancer Inst. 93:463-471, March 2001) demonstrated the ability of an oligonucleotide having 100% complementarity to the bcl-2 mRNA and having 3 mismatches to the bcl-xL mRNA to reduce the expression of both bcl-2 and bcl-xL in vitro and in vivo. Furthermore, this oligonucleotide demonstrated potent anti-tumor activity in vivo.

Maher and Dolnick (Nuc. Acid. Res. 16:3341-3358, 1988) tested a series of tandem 14 nucleobase antisense oligonucleotides, and a 28 and 42 nucleobase antisense oligonucleotides comprised of the sequence of two or three of the tandem antisense oligonucleotides, respectively, for their ability to arrest translation of human DHFR in a rabbit reticulocyte assay. Each of the three 14 nucleobase antisense oligonucleotides alone was able to inhibit translation, albeit at a more modest level than the 28 or 42 nucleobase antisense oligonucleotides.

Certain Antisense Compound Motifs and Mechanisms

In certain embodiments, antisense compounds have chemically modified subunits arranged in patterns, or motifs, to confer to the antisense compounds properties such as enhanced inhibitory activity, increased binding affinity for a target nucleic acid, or resistance to degradation by in vivo nucleases. Chimeric antisense compounds typically contain at least one region modified so as to confer increased resistance to nuclease degradation, increased cellular uptake, increased binding affinity for the target nucleic acid, and/or increased inhibitory activity. A second region of a chimeric antisense compound may confer another desired property e.g., serve as a substrate for the cellular endonuclease RNase H, which cleaves the RNA strand of an RNA:DNA duplex.

Antisense activity may result from any mechanism involving the hybridization of the antisense compound (e.g., oligonucleotide) with a target nucleic acid, wherein the hybridization ultimately results in a biological effect. In certain embodiments, the amount and/or activity of the target nucleic acid is modulated. In certain embodiments, the amount and/or activity of the target nucleic acid is reduced. In certain embodiments, hybridization of the antisense compound to the target nucleic acid ultimately results in target nucleic acid degradation. In certain embodiments, hybridization of the antisense compound to the target nucleic acid does not result in target nucleic acid degradation. In certain such embodiments, the presence of the antisense compound hybridized with the target nucleic acid (occupancy) results in a modulation of antisense activity. In certain embodiments, antisense compounds having a particular chemical motif or pattern of chemical modifications are particularly suited to exploit one or more mechanisms. In certain embodiments, antisense compounds function through more than one mechanism and/or through mechanisms that have not been elucidated. Accordingly, the antisense compounds described herein are not limited by particular mechanism.

Antisense mechanisms include, without limitation, RNase H mediated antisense; RNAi mechanisms, which utilize the RISC pathway and include, without limitation, siRNA, ssRNA and microRNA mechanisms; and occupancy based mechanisms. Certain antisense compounds may act through more than one such mechanism and/or through additional mechanisms.

RNase H-Mediated Antisense

In certain embodiments, antisense activity results at least in part from degradation of target RNA by RNase H. RNase H is a cellular endonuclease that cleaves the RNA strand of an RNA:DNA duplex. It is known in the art that single-stranded antisense compounds which are "DNA-like" elicit RNase H activity in mammalian cells. Accordingly, antisense compounds comprising at least a portion of DNA or DNA-like nucleosides may activate RNase H, resulting in cleavage of the target nucleic acid. In certain embodiments, antisense compounds that utilize RNase H comprise one or more modified nucleosides. In certain embodiments, such antisense compounds comprise at least one block of 1-8 modified nucleosides. In certain such embodiments, the modified nucleosides do not support RNase H activity. In certain embodiments, such antisense compounds are gapmers, as described herein. In certain such embodiments, the gap of the gapmer comprises DNA nucleosides. In certain such embodiments, the gap of the gapmer comprises DNA-like nucleosides. In certain such embodiments, the gap of the gapmer comprises DNA nucleosides and DNA-like nucleosides.

Certain antisense compounds having a gapmer motif are considered chimeric antisense compounds. In a gapmer an internal region having a plurality of nucleotides that supports RNaseH cleavage is positioned between external regions having a plurality of nucleotides that are chemically distinct from the nucleosides of the internal region. In the case of an antisense oligonucleotide having a gapmer motif, the gap segment generally serves as the substrate for endonuclease cleavage, while the wing segments comprise modified nucleosides. In certain embodiments, the regions of a gapmer are differentiated by the types of sugar moieties comprising each distinct region. The types of sugar moieties that are used to differentiate the regions of a gapmer may in some embodiments include β-D-ribonucleosides, β-D-deoxyribonucleosides, 2'-modified nucleosides (such 2'-modified nucleosides may include 2'-MOE and 2'-O—CH$_3$, among others), and bicyclic sugar modified nucleosides (such bicyclic sugar modified nucleosides may include those having a constrained ethyl). In certain embodiments, nucleosides in the wings may include several modified sugar moieties, including, for example 2'-MOE and bicyclic sugar moieties such as constrained ethyl or LNA. In certain embodiments, wings may include several modified and unmodified sugar moieties. In certain embodiments, wings may include various combinations of 2'-MOE nucleosides, bicyclic sugar moieties such as constrained ethyl nucleosides or LNA nucleosides, and 2'-deoxynucleosides.

Each distinct region may comprise uniform sugar moieties, variant, or alternating sugar moieties. The wing-gap-wing motif is frequently described as "X—Y—Z", where "X" represents the length of the 5'-wing, "Y" represents the length of the gap, and "Z" represents the length of the 3'-wing. "X" and "Z" may comprise uniform, variant, or alternating sugar moieties. In certain embodiments, "X" and "Y" may include one or more 2'-deoxynucleosides. "Y" may comprise 2'-deoxynucleosides. As used herein, a gapmer described as "X—Y—Z" has a configuration such that the gap is positioned immediately adjacent to each of the 5'-wing and the 3' wing. Thus, no intervening nucleotides exist between the 5'-wing and gap, or the gap and the 3'-wing. Any of the antisense compounds described herein can have a gapmer motif. In certain embodiments, "X" and "Z" are the same; in other embodiments they are different. In certain embodiments, "Y" is between 8 and 15 nucleosides. X, Y, or Z can be any of 1, 2, 3, 4, 5, 6, 7, 8, 9, 10, 11, 12, 13, 14, 15, 16, 17, 18, 19, 20, 25, 30 or more nucleosides.

In certain embodiments, the antisense compound targeted to an ANGPTL3 nucleic acid has a gapmer motif in which the gap consists of 6, 7, 8, 9, 10, 11, 12, 13, 14, 15, or 16 linked nucleosides.

In certain embodiments, the antisense oligonucleotide has a sugar motif described by Formula A as follows: $(J)_m\text{-}(B)_n\text{-}(J)_p\text{-}(B)_r\text{-}(A)_t\text{-}(D)_g\text{-}(A)_v\text{-}(B)_w\text{-}(J)_x\text{-}(B)_y\text{-}(J)_z$.

wherein:
each A is independently a 2'-substituted nucleoside;
each B is independently a bicyclic nucleoside;
each J is independently either a 2'-substituted nucleoside or a 2'-deoxynucleoside;
each D is a 2'-deoxynucleoside;
m is 0-4; n is 0-2; p is 0-2; r is 0-2; t is 0-2; v is 0-2; w is 0-4; x is 0-2; y is 0-2; z is 0-4; g is 6-14; provided that:
at least one of m, n, and r is other than 0;
at least one of w and y is other than 0;
the sum of m, n, p, r, and t is from 2 to 5; and
the sum of v, w, x, y, and z is from 2 to 5.

RNAi Compounds

In certain embodiments, antisense compounds are interfering RNA compounds (RNAi), which include double-stranded RNA compounds (also referred to as short-interfering RNA or siRNA) and single-stranded RNAi compounds (or ssRNA). Such compounds work at least in part through the RISC pathway to degrade and/or sequester a target nucleic acid (thus, include microRNA/microRNA-mimic compounds). In certain embodiments, antisense compounds comprise modifications that make them particularly suited for such mechanisms.

i. ssRNA Compounds

In certain embodiments, antisense compounds including those particularly suited for use as single-stranded RNAi compounds (ssRNA) comprise a modified 5'-terminal end. In certain such embodiments, the 5'-terminal end comprises a modified phosphate moiety. In certain embodiments, such modified phosphate is stabilized (e.g., resistant to degradation/cleavage compared to unmodified 5'-phosphate). In certain embodiments, such 5'-terminal nucleosides stabilize the 5'-phosphorous moiety. Certain modified 5'-terminal nucleosides may be found in the art, for example in WO/2011/139702.

In certain embodiments, the 5'-nucleoside of an ssRNA compound has Formula IIc:

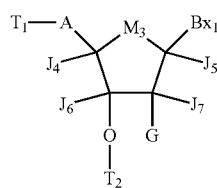

wherein:

$T_1$ is an optionally protected phosphorus moiety;

$T_2$ is an internucleoside linking group linking the compound of Formula IIc to the oligomeric compound;

A has one of the formulas:

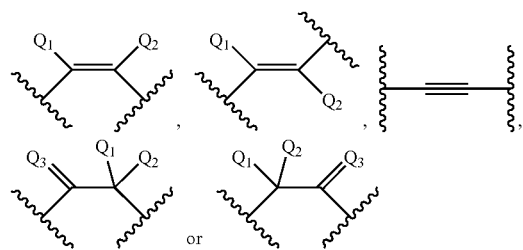

$Q_1$ and $Q_2$ are each, independently, H, halogen, $C_1$-$C_6$ alkyl, substituted $C_1$-$C_6$ alkyl, $C_1$-$C_6$ alkoxy, substituted $C_1$-$C_6$ alkoxy, $C_2$-$C_6$ alkenyl, substituted $C_2$-$C_6$ alkenyl, $C_2$-$C_6$ alkynyl, substituted $C_2$-$C_6$ alkynyl or $N(R_3)(R_4)$;

$Q_3$ is O, S, $N(R_5)$ or $C(R_6)(R_7)$;

each $R_3$, $R_4$ $R_5$, $R_6$ and $R_7$ is, independently, H, $C_1$-$C_6$ alkyl, substituted $C_1$-$C_6$ alkyl or $C_1$-$C_6$ alkoxy;

$M_3$ is O, S, $NR_{14}$, $C(R_{15})(R_{16})$, $C(R_{15})(R_{16})C(R_{17})(R_{18})$, $C(R_{15})$=$C(R_{17})$, $OC(R_{15})(R_{16})$ or $OC(R_{15})(Bx_2)$;

$R_{14}$ is H, $C_1$-$C_6$ alkyl, substituted $C_1$-$C_6$ alkyl, $C_1$-$C_6$ alkoxy, substituted $C_1$-$C_6$ alkoxy, $C_2$-$C_6$ alkenyl, substituted $C_2$-$C_6$ alkenyl, $C_2$-$C_6$ alkynyl or substituted $C_2$-$C_6$ alkynyl;

$R_{15}$, $R_{16}$, $R_{17}$ and $R_{18}$ are each, independently, H, halogen, $C_1$-$C_6$ alkyl, substituted $C_1$-$C_6$ alkyl, $C_1$-$C_6$ alkoxy, substituted $C_1$-$C_6$ alkoxy, $C_2$-$C_6$ alkenyl, substituted $C_2$-$C_6$ alkenyl, $C_2$-$C_6$ alkynyl or substituted $C_2$-$C_6$ alkynyl;

$Bx_1$ is a heterocyclic base moiety;

or if $Bx_2$ is present then $Bx_2$ is a heterocyclic base moiety and $Bx_1$ is H, halogen, $C_1$-$C_6$ alkyl, substituted $C_1$-$C_6$ alkyl, $C_1$-$C_6$ alkoxy, substituted $C_1$-$C_6$ alkoxy, $C_2$-$C_6$ alkenyl, substituted $C_2$-$C_6$ alkenyl, $C_2$-$C_6$ alkynyl or substituted $C_2$-$C_6$ alkynyl;

$J_4$, $J_5$, $J_6$ and $J_7$ are each, independently, H, halogen, $C_1$-$C_6$ alkyl, substituted $C_1$-$C_6$ alkyl, $C_1$-$C_6$ alkoxy, substituted $C_1$-$C_6$ alkoxy, $C_2$-$C_6$ alkenyl, substituted $C_2$-$C_6$ alkenyl, $C_2$-$C_6$ alkynyl or substituted $C_2$-$C_6$ alkynyl;

or $J_4$ forms a bridge with one of $J_5$ or $J_7$ wherein said bridge comprises from 1 to 3 linked biradical groups selected from O, S, $NR_{19}$, $C(R_{20})(R_{21})$, $C(R_{20})$=$C(R_{21})$, g=$C(R_{20})(R_{21})$] and C(=O) and the other two of $J_5$, $J_6$ and $J_7$ are each, independently, H, halogen, $C_1$-$C_6$ alkyl, substituted $C_1$-$C_6$ alkyl, $C_1$-$C_6$ alkoxy, substituted $C_1$-$C_6$ alkoxy, $C_2$-$C_6$ alkenyl, substituted $C_2$-$C_6$ alkenyl, $C_2$-$C_6$ alkynyl or substituted $C_2$-$C_6$ alkynyl;

each $R_{19}$, $R_{20}$ and $R_{21}$ is, independently, H, $C_1$-$C_6$ alkyl, substituted $C_1$-$C_6$ alkyl, $C_1$-$C_6$ alkoxy, substituted $C_1$-$C_6$ alkoxy, $C_2$-$C_6$ alkenyl, substituted $C_2$-$C_6$ alkenyl, $C_2$-$C_6$ alkynyl or substituted $C_2$-$C_6$ alkynyl;

G is H, OH, halogen or O—$[C(R_8)(R_9)]_n$—$[(C$=$O)_m$—$X_1]_j$—Z;

each $R_8$ and $R_9$ is, independently, H, halogen, $C_1$-$C_6$ alkyl or substituted $C_1$-$C_6$ alkyl;

$X_1$ is O, S or $N(E_1)$;

Z is H, halogen, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, substituted $C_2$-$C_6$ alkynyl or $N(E_2)(E_3)$;

$E_1$, $E_2$ and $E_3$ are each, independently, H, $C_1$-$C_6$ alkyl or substituted $C_1$-$C_6$ alkyl;

n is from 1 to about 6;

m is 0 or 1;

j is 0 or 1;

each substituted group comprises one or more optionally protected substituent groups independently selected from halogen, $OJ_1$, $N(J_1)(J_2)$, =$NJ_1$, $SJ_1$, $N_3$, CN, $OC$(=$X_2$)$J_1$, $OC$(=$X_2$)$N(J_1)(J_2)$ and C(=$X_2$)$N(J_1)(J_2)$;

$X_2$ is O, S or $NJ_3$;

each $J_1$, $J_2$ and $J_3$ is, independently, H or $C_1$-$C_6$ alkyl;

when j is 1 then Z is other than halogen or N(E2)(E3); and wherein said oligomeric compound comprises from 8 to 40 monomeric subunits and is hybridizable to at least a portion of a target nucleic acid.

In certain embodiments, $M_3$ is O, CH=CH, $OCH_2$ or $OC(H)(Bx_2)$. In certain embodiments, $M_3$ is O.

In certain embodiments, $J_4$, $J_5$, $J_6$ and $J_7$ are each H. In certain embodiments, $J_4$ forms a bridge with one of $J_5$ or $J_7$.

In certain embodiments, A has one of the formulas:

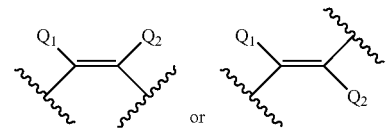

wherein:

$Q_1$ and $Q_2$ are each, independently, H, halogen, $C_1$-$C_6$ alkyl, substituted $C_1$-$C_6$ alkyl, $C_1$-$C_6$ alkoxy or substituted $C_1$-$C_6$ alkoxy. In certain embodiments, $Q_1$ and $Q_2$ are each H. In certain embodiments, $Q_1$ and $Q_2$ are each, independently, H or halogen. In certain embodiments, $Q_1$ and $Q_2$ is H and the other of $Q_1$ and $Q_2$ is F, $CH_3$ or $OCH_3$.

In certain embodiments, $T_1$ has the formula:

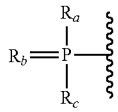

wherein:

$R_a$ and $R_c$ are each, independently, protected hydroxyl, protected thiol, $C_1$-$C_6$ alkyl, substituted $C_1$-$C_6$ alkyl, $C_1$-$C_6$ alkoxy, substituted $C_1$-$C_6$ alkoxy, protected amino or substituted amino; and $R_b$ is O or S. In certain embodiments, $R_b$ is O and $R_a$ and $R_b$ are each, independently, $OCH_3$, $OCH_2CH_3$ or $CH(CH_3)_2$.

In certain embodiments, G is halogen, $OCH_3$, $OCH_2F$, $OCHF_2$, $OCF_3$, $OCH_2CH_3$, $O(CH_2)_2F$, $OCH_2CHF_2$, $OCH_2CF_3$, $OCH_2$—$CH$=$CH_2$, $O(CH_2)_2$—$OCH_3$, $O(CH_2)_2$—$SCH_3$, $O(CH_2)_2$—$OCF_3$, $O(CH_2)_3$—$N(R_{10})(R_{11})$, $O(CH_2)_2$—$ON(R_{10})(R_{11})$, $O(CH_2)_2$—$O(CH_2)_2$—$N(R_{10})(R_{11})$, $OCH_2C$(=O)—$N(R_{10})(R_{11})$, $OCH_2C$(=O)—$N(R_{12})$—$(CH_2)_2$—$N(R_{10})(R_{11})$ or $O(CH_2)_2$—$N(R_{12})$—$C$(=$NR_{13}$)[$N(R_{10})(R_{11})$] wherein $R_{10}$, $R_{11}$, $R_{12}$ and $R_{13}$ are each, independently, H or $C_1$-$C_6$ alkyl. In certain embodiments, G is halogen, $OCH_3$, $OCF_3$, $OCH_2CH_3$, $OCH_2CF_3$, $OCH_2$—$CH$=$CH_2$, $O(CH_2)_2$—$OCH_3$, $O(CH_2)_2$—$O(CH_2)_2$—$N(CH_3)_2$, $OCH_2C$(=O)—$N(H)CH_3$, $OCH_2C$(=O)—$N(H)$—$(CH_2)_2$—$N(CH_3)_2$ or $OCH_2$—$N(H)$—$C$(=$NH$)$NH_2$. In certain embodiments, G is F, $OCH_3$ or $O(CH_2)_2$—$OCH_3$. In certain embodiments, G is $O(CH_2)_2$—$OCH_3$.

In certain embodiments, the 5'-terminal nucleoside has Formula IIe:

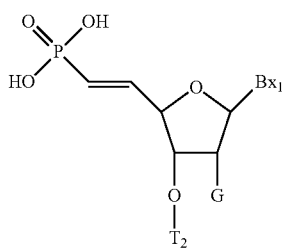

In certain embodiments, antisense compounds, including those particularly suitable for ssRNA comprise one or more type of modified sugar moieties and/or naturally occurring sugar moieties arranged along an oligonucleotide or region thereof in a defined pattern or sugar modification motif. Such motifs may include any of the sugar modifications discussed herein and/or other known sugar modifications.

In certain embodiments, the oligonucleotides comprise or consist of a region having uniform sugar modifications. In certain such embodiments, each nucleoside of the region comprises the same RNA-like sugar modification. In certain embodiments, each nucleoside of the region is a 2'-F nucleoside. In certain embodiments, each nucleoside of the region is a 2'-OMe nucleoside. In certain embodiments, each nucleoside of the region is a 2'-MOE nucleoside. In certain embodiments, each nucleoside of the region is a cEt nucleoside. In certain embodiments, each nucleoside of the region is an LNA nucleoside. In certain embodiments, the uniform region constitutes all or essentially all of the oligonucleotide. In certain embodiments, the region constitutes the entire oligonucleotide except for 1-4 terminal nucleosides.

In certain embodiments, oligonucleotides comprise one or more regions of alternating sugar modifications, wherein the nucleosides alternate between nucleotides having a sugar modification of a first type and nucleotides having a sugar modification of a second type. In certain embodiments, nucleosides of both types are RNA-like nucleosides. In certain embodiments the alternating nucleosides are selected from: 2'-OMe, 2'-F, 2'-MOE, LNA, and cEt. In certain embodiments, the alternating modifications are 2'-F and 2'-OMe. Such regions may be contiguous or may be interrupted by differently modified nucleosides or conjugated nucleosides.

In certain embodiments, the alternating region of alternating modifications each consist of a single nucleoside (i.e., the pattern is $(AB)_xA_y$ wherein A is a nucleoside having a sugar modification of a first type and B is a nucleoside having a sugar modification of a second type; x is 1-20 and y is 0 or 1). In certain embodiments, one or more alternating regions in an alternating motif includes more than a single nucleoside of a type. For example, oligonucleotides may include one or more regions of any of the following nucleoside motifs:

AABBAA;

ABBABB;

AABAAB;

ABBABAABB;

ABABAA;

AABABAB;

ABABAA;

ABBAABBABABAA;

BABBAABBABABAA;
or

ABABBAABBABABAA;

wherein A is a nucleoside of a first type and B is a nucleoside of a second type. In certain embodiments, A and B are each selected from 2'-F, 2'-OMe, BNA, and MOE.

In certain embodiments, oligonucleotides having such an alternating motif also comprise a modified 5' terminal nucleoside, such as those of formula IIc or IIe.

In certain embodiments, oligonucleotides comprise a region having a 2-2-3 motif. Such regions comprises the following motif:

-(A)_2-(B)_x-(A)_2-(C)_y-(A)_3- wherein: A is a first type of modified nucleoside;

B and C, are nucleosides that are differently modified than A, however, B and C may have the same or different modifications as one another;

x and y are from 1 to 15.

In certain embodiments, A is a 2'-OMe modified nucleoside. In certain embodiments, B and C are both 2'-F modified nucleosides. In certain embodiments, A is a 2'-OMe modified nucleoside and B and C are both 2'-F modified nucleosides.

In certain embodiments, oligonucleosides have the following sugar motif:

wherein:

Q is a nucleoside comprising a stabilized phosphate moiety. In certain embodiments, Q is a nucleoside having Formula IIc or IIe;

A is a first type of modified nucleoside;

B is a second type of modified nucleoside;

D is a modified nucleoside comprising a modification different from the nucleoside adjacent to it.

Thus, if y is 0, then D must be differently modified than B and if y is 1, then D must be differently modified than A. In certain embodiments, D differs from both A and B.

X is 5-15;

Y is 0 or 1;

Z is 0-4.

In certain embodiments, oligonucleosides have the following sugar motif:

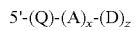

wherein:

Q is a nucleoside comprising a stabilized phosphate moiety. In certain embodiments, Q is a nucleoside having Formula IIc or IIe;

A is a first type of modified nucleoside;

D is a modified nucleoside comprising a modification different from A.

X is 11-30;

Z is 0-4.

In certain embodiments A, B, C, and D in the above motifs are selected from: 2'-OMe, 2'-F, 2'-MOE, LNA, and cEt. In certain embodiments, D represents terminal nucleosides. In certain embodiments, such terminal nucleosides are not designed to hybridize to the target nucleic acid (though one or more might hybridize by chance). In certain embodiments, the nucleobase of each D nucleoside is adenine, regardless of the identity of the nucleobase at the corresponding position of the target nucleic acid. In certain embodiments the nucleobase of each D nucleoside is thymine.

In certain embodiments, antisense compounds, including those particularly suited for use as ssRNA comprise modified internucleoside linkages arranged along the oligonucleotide or region thereof in a defined pattern or modified internucleoside linkage motif. In certain embodiments, oligonucleotides comprise a region having an alternating internucleoside linkage motif. In certain embodiments, oligonucleotides comprise a region of uniformly modified internucleoside linkages. In certain such embodiments, the oligonucleotide comprises a region that is uniformly linked by phosphorothioate internucleoside linkages. In certain embodiments, the oligonucleotide is uniformly linked by phosphorothioate internucleoside linkages. In certain embodiments, each internucleoside linkage of the oligonucleotide is selected from phosphodiester and phosphorothioate. In certain embodiments, each internucleoside linkage of the oligonucleotide is selected from phosphodiester and phosphorothioate and at least one internucleoside linkage is phosphorothioate.

In certain embodiments, the oligonucleotide comprises at least 6 phosphorothioate internucleoside linkages. In certain embodiments, the oligonucleotide comprises at least 8 phosphorothioate internucleoside linkages. In certain embodiments, the oligonucleotide comprises at least 10 phosphorothioate internucleoside linkages. In certain embodiments, the oligonucleotide comprises at least one block of at least 6 consecutive phosphorothioate internucleoside linkages. In certain embodiments, the oligonucleotide comprises at least one block of at least 8 consecutive phosphorothioate internucleoside linkages. In certain embodiments, the oligonucleotide comprises at least one block of at least 10 consecutive phosphorothioate internucleoside linkages. In certain embodiments, the oligonucleotide comprises at least one block of at least one 12 consecutive phosphorothioate internucleoside linkages. In certain such embodiments, at least one such block is located at the 3' end of the oligonucleotide. In certain such embodiments, at least one such block is located within 3 nucleosides of the 3' end of the oligonucleotide.

Oligonucleotides having any of the various sugar motifs described herein, may have any linkage motif. For example, the oligonucleotides, including but not limited to those described above, may have a linkage motif selected from non-limiting the table below:

| 5' most linkage | Central region | 3'-region |
| --- | --- | --- |
| PS | Alternating PO/PS | 6 PS |
| PS | Alternating PO/PS | 7 PS |
| PS | Alternating PO/PS | 8 PS | ii. siRNA Compounds

In certain embodiments, antisense compounds are double-stranded RNAi compounds (siRNA). In such embodiments, one or both strands may comprise any modification motif described above for ssRNA. In certain embodiments, ssRNA compounds may be unmodified RNA. In certain embodiments, siRNA compounds may comprise unmodified RNA nucleosides, but modified internucleoside linkages.

Several embodiments relate to double-stranded compositions wherein each strand comprises a motif defined by the location of one or more modified or unmodified nucleosides. In certain embodiments, compositions are provided comprising a first and a second oligomeric compound that are fully or at least partially hybridized to form a duplex region and further comprising a region that is complementary to and hybridizes to a nucleic acid target. It is suitable that such a composition comprise a first oligomeric compound that is an antisense strand having full or partial complementarity to a nucleic acid target and a second oligomeric compound that is a sense strand having one or more regions of complementarity to and forming at least one duplex region with the first oligomeric compound.

The compositions of several embodiments modulate gene expression by hybridizing to a nucleic acid target resulting in loss of its normal function. In some embodiments, the target nucleic acid is ANGPTL3. In certain embodiment, the degradation of the targeted ANGPTL3 is facilitated by an activated RISC complex that is formed with compositions disclosed herein.

Several embodiments are directed to double-stranded compositions wherein one of the strands is useful in, for example, influencing the preferential loading of the opposite strand into the RISC (or cleavage) complex. The compositions are useful for targeting selected nucleic acid molecules and modulating the expression of one or more genes. In some embodiments, the compositions of the present invention hybridize to a portion of a target RNA resulting in loss of normal function of the target RNA.

Certain embodiments are drawn to double-stranded compositions wherein both the strands comprises a hemimer motif, a fully modified motif, a positionally modified motif or an alternating motif. Each strand of the compositions of the present invention can be modified to fulfil a particular role in for example the siRNA pathway. Using a different motif in each strand or the same motif with different chemical modifications in each strand permits targeting the antisense strand for the RISC complex while inhibiting the incorporation of the sense strand. Within this model, each strand can be independently modified such that it is enhanced for its particular role. The antisense strand can be modified at the 5'-end to enhance its role in one region of the RISC while the 3'-end can be modified differentially to enhance its role in a different region of the RISC.

The double-stranded oligonucleotide molecules can be a double-stranded polynucleotide molecule comprising self-complementary sense and antisense regions, wherein the antisense region comprises nucleotide sequence that is complementary to nucleotide sequence in a target nucleic acid molecule or a portion thereof and the sense region having nucleotide sequence corresponding to the target nucleic acid sequence or a portion thereof. The double-stranded oligonucleotide molecules can be assembled from two separate oligonucleotides, where one strand is the sense strand and the other is the antisense strand, wherein the antisense and sense strands are self-complementary (i.e. each strand comprises nucleotide sequence that is complementary to nucleotide sequence in the other strand; such as where the antisense strand and sense strand form a duplex or double-stranded structure, for example wherein the double-stranded region is about 15 to about 30, e.g., about 15, 16, 17, 18, 19, 20, 21, 22, 23, 24, 25, 26, 27, 28, 29 or 30 base pairs; the antisense strand comprises nucleotide sequence that is complementary to nucleotide sequence in a target nucleic acid molecule or a portion thereof and the sense strand comprises nucleotide sequence corresponding to the target nucleic acid sequence or a portion thereof (e.g., about 15 to about 25 or more nucleotides of the double-stranded oligonucleotide molecule are complementary to the target nucleic acid or a portion thereof). Alternatively, the double-stranded oligonucleotide is assembled from a single oligonucleotide, where the self-complementary sense and antisense regions of the siRNA are linked by means of a nucleic acid based or non-nucleic acid-based linker(s).

The double-stranded oligonucleotide can be a polynucleotide with a duplex, asymmetric duplex, hairpin or asymmetric hairpin secondary structure, having self-complementary sense and antisense regions, wherein the antisense region comprises nucleotide sequence that is complementary to nucleotide sequence in a separate target nucleic acid molecule or a portion thereof and the sense region having nucleotide sequence corresponding to the target nucleic acid sequence or a portion thereof. The double-stranded oligonucleotide can be a circular single-stranded polynucleotide having two or more loop structures and a stem comprising self-complementary sense and antisense regions, wherein the antisense region comprises nucleotide sequence that is complementary to nucleotide sequence in a target nucleic acid molecule or a portion thereof and the sense region having nucleotide sequence corresponding to the target nucleic acid sequence or a portion thereof, and wherein the circular polynucleotide can be processed either in vivo or in vitro to generate an active siRNA molecule capable of mediating RNAi.

In certain embodiments, the double-stranded oligonucleotide comprises separate sense and antisense sequences or regions, wherein the sense and antisense regions are covalently linked by nucleotide or non-nucleotide linkers molecules as is known in the art, or are alternately non-covalently linked by ionic interactions, hydrogen bonding, van der waals interactions, hydrophobic interactions, and/or stacking interactions. In certain embodiments, the double-stranded oligonucleotide comprises nucleotide sequence that is complementary to nucleotide sequence of a target gene. In another embodiment, the double-stranded oligonucleotide interacts with nucleotide sequence of a target gene in a manner that causes inhibition of expression of the target gene.

As used herein, double-stranded oligonucleotides need not be limited to those molecules containing only RNA, but further encompasses chemically modified nucleotides and non-nucleotides. In certain embodiments, the short interfering nucleic acid molecules lack 2'-hydroxy (2'-OH) containing nucleotides. In certain embodiments short interfering nucleic acids optionally do not include any ribonucleotides (e.g., nucleotides having a 2'—OH group). Such double-stranded oligonucleotides that do not require the presence of ribonucleotides within the molecule to support RNAi can however have an attached linker or linkers or other attached or associated groups, moieties, or chains containing one or more nucleotides with 2'—OH groups. Optionally, double-stranded oligonucleotides can comprise ribonucleotides at about 5, 10, 20, 30, 40, or 50% of the nucleotide positions. As used herein, the term siRNA is meant to be equivalent to other terms used to describe nucleic acid molecules that are capable of mediating sequence specific RNAi, for example short interfering RNA (siRNA), double-stranded RNA (dsRNA), micro-RNA (miRNA), short hairpin RNA (shRNA), short interfering oligonucleotide, short interfering nucleic acid, short interfering modified oligonucleotide, chemically modified siRNA, post-transcriptional gene silencing RNA (ptgsRNA), and others. In addition, as used herein, the term RNAi is meant to be equivalent to other terms used to describe sequence specific RNA interference, such as post transcriptional gene silencing, translational inhibition, or epigenetics. For example, double-stranded oligonucleotides can be used to epigenetically silence genes at both the post-transcriptional level and the pre-transcriptional level. In a non-limiting example, epigenetic regulation of gene expression by siRNA molecules of the invention can result from siRNA mediated modification of chromatin structure or methylation pattern to alter gene expression (see, for example, Verdel et al., 2004, Science, 303, 672-676; Pal-Bhadra et al., 2004, Science, 303, 669-672; Allshire, 2002, Science, 297, 1818-1819; Volpe et al., 2002, Science, 297, 1833-1837; Jenuwein, 2002, Science, 297, 2215-2218; and Hall et al., 2002, Science, 297, 2232-2237).

It is contemplated that compounds and compositions of several embodiments provided herein can target ANGPTL3 by a dsRNA-mediated gene silencing or RNAi mechanism, including, e.g., "hairpin" or stem-loop double-stranded RNA effector molecules in which a single RNA strand with self-complementary sequences is capable of assuming a double-stranded conformation, or duplex dsRNA effector molecules comprising two separate strands of RNA. In various embodiments, the dsRNA consists entirely of ribonucleotides or consists of a mixture of ribonucleotides and deoxynucleotides, such as the RNA/DNA hybrids disclosed, for example, by WO 00/63364, filed Apr. 19, 2000, or U.S. Ser. No. 60/130,377, filed Apr. 21, 1999. The dsRNA or dsRNA effector molecule may be a single molecule with a region of self-complementarity such that nucleotides in one segment of the molecule base pair with nucleotides in another segment of the molecule. In various embodiments, a dsRNA that consists of a single molecule consists entirely of ribonucleotides or includes a region of ribonucleotides that is complementary to a region of deoxyribonucleotides. Alternatively, the dsRNA may include two different strands that have a region of complementarity to each other.

In various embodiments, both strands consist entirely of ribonucleotides, one strand consists entirely of ribonucleotides and one strand consists entirely of deoxyribonucleotides, or one or both strands contain a mixture of ribonucleotides and deoxyribonucleotides. In certain embodiments, the regions of complementarity are at least 70, 80, 90, 95, 98, or 100% complementary to each other and to a target nucleic acid sequence. In certain embodiments, the region of the dsRNA that is present in a double-stranded conformation includes at least 19, 20, 21, 22, 23, 24, 25, 26, 27, 28, 29, 30, 50, 75, 100, 200, 500, 1000, 2000 or 5000 nucleotides or includes all of the nucleotides in a cDNA or other target nucleic acid sequence being represented in the dsRNA. In some embodiments, the dsRNA does not contain any single stranded regions, such as single stranded ends, or the dsRNA is a hairpin. In other embodiments, the dsRNA has one or more single stranded regions or overhangs. In certain embodiments, RNA/DNA hybrids include a DNA strand or region that is an antisense strand or region (e.g, has at least 70, 80, 90, 95, 98, or 100% complementarity to a target nucleic acid) and an RNA strand or region that is a sense strand or region (e.g, has at least 70, 80, 90, 95, 98, or 100% identity to a target nucleic acid), and vice versa.

In various embodiments, the RNA/DNA hybrid is made in vitro using enzymatic or chemical synthetic methods such as those described herein or those described in WO 00/63364, filed Apr. 19, 2000, or U.S. Ser. No. 60/130,377, filed Apr. 21, 1999. In other embodiments, a DNA strand synthesized in vitro is complexed with an RNA strand made in vivo or in vitro before, after, or concurrent with the transformation of the DNA strand into the cell. In yet other embodiments, the dsRNA is a single circular nucleic acid containing a sense and an antisense region, or the dsRNA includes a circular nucleic acid and either a second circular nucleic acid or a linear nucleic acid (see, for example, WO 00/63364, filed Apr. 19, 2000, or U.S. Ser. No. 60/130,377, filed Apr. 21, 1999.) Exemplary circular nucleic acids include lariat structures in which the free 5' phosphoryl group of a nucleotide becomes linked to the 2' hydroxyl group of another nucleotide in a loop back fashion.

In other embodiments, the dsRNA includes one or more modified nucleotides in which the 2' position in the sugar contains a halogen (such as fluorine group) or contains an alkoxy group (such as a methoxy group) which increases the half-life of the dsRNA in vitro or in vivo compared to the corresponding dsRNA in which the corresponding 2' position contains a hydrogen or an hydroxyl group. In yet other embodiments, the dsRNA includes one or more linkages between adjacent nucleotides other than a naturally-occurring phosphodiester linkage. Examples of such linkages include phosphoramide, phosphorothioate, and phosphorodithioate linkages. The dsRNAs may also be chemically modified nucleic acid molecules as taught in U.S. Pat. No. 6,673,661. In other embodiments, the dsRNA contains one or two capped strands, as disclosed, for example, by WO 00/63364, filed Apr. 19, 2000, or U.S. Ser. No. 60/130,377, filed Apr. 21, 1999.

In other embodiments, the dsRNA can be any of the at least partially dsRNA molecules disclosed in WO 00/63364, as well as any of the dsRNA molecules described in U.S. Provisional Application 60/399,998; and U.S. Provisional Application 60/419,532, and PCT/US2003/033466, the teaching of which is hereby incorporated by reference. Any of the dsRNAs may be expressed in vitro or in vivo using the methods described herein or standard methods, such as those described in WO 00/63364.

Occupancy

In certain embodiments, antisense compounds are not expected to result in cleavage or the target nucleic acid via RNase H or to result in cleavage or sequestration through the RISC pathway. In certain such embodiments, antisense activity may result from occupancy, wherein the presence of the hybridized antisense compound disrupts the activity of the target nucleic acid. In certain such embodiments, the antisense compound may be uniformly modified or may comprise a mix of modifications and/or modified and unmodified nucleosides.

Target *Nucleic Acids, Target Regions and Nucleotide Sequences*

Nucleotide sequences that encode ANGPTL3 include, without limitation, the following: the human sequence as set forth in GenBank Accession No. NM_014495.2 (incorporated herein as SEQ ID NO: 1) or GenBank Accession No. NT_032977.9 nucleotides 33032001 to 33046000 (incorporated herein as SEQ ID NO: 2). It is understood that the sequence set forth in each SEQ ID NO in the Examples contained herein is independent of any modification to a sugar moiety, an internucleoside linkage, or a nucleobase. As such, antisense compounds defined by a SEQ ID NO can comprise, independently, one or more modifications to a sugar moiety, an internucleoside linkage, or a nucleobase. Antisense compounds described by Isis Number (Isis No) indicate a combination of nucleobase sequence and motif.

In certain embodiments, a target region is a structurally defined region of the target nucleic acid. For example, a target region can encompass a 3' UTR, a 5' UTR, an exon, an intron, an exon/intron junction, a coding region, a translation initiation region, translation termination region, or other defined nucleic acid region. The structurally defined regions for ANGPTL3 can be obtained by accession number from sequence databases such as NCBI and such information is incorporated herein by reference. In certain embodiments, a target region can encompass the sequence from a 5' target site of one target segment within the target region to a 3' target site of another target segment within the target region.

In certain embodiments, a "target segment" is a smaller, sub-portion of a target region within a nucleic acid. For example, a target segment can be the sequence of nucleotides of a target nucleic acid to which one or more antisense compound is targeted. "5' target site" or "5' start stie" refers to the 5'-most nucleotide of a target segment. "3' target site" or "3' stop site" refers to the 3'-most nucleotide of a target segment.

Targeting includes determination of at least one target segment to which an antisense compound hybridizes, such that a desired effect occurs. In certain embodiments, the desired effect is a reduction in mRNA target nucleic acid levels. In certain embodiments, the desired effect is reduction of levels of protein encoded by the target nucleic acid or a phenotypic change associated with the target nucleic acid.

A target region can contain one or more target segments. Multiple target segments within a target region can be overlapping. Alternatively, they can be non-overlapping. In certain embodiments, target segments within a target region are separated by no more than about 300 nucleotides. In certain embodiments, target segments within a target region are separated by a number of nucleotides that is, is about, is no more than, is no more than about, 250, 200, 150, 100, 90, 80, 70, 60, 50, 40, 30, 20, or 10 nucleotides on the target nucleic acid, or is a range defined by any two of the preceding values. In certain embodiments, target segments within a target region are separated by no more than, or no more than about, 5 nucleotides on the target nucleic acid. In certain embodiments, target segments are contiguous. Contemplated are target regions defined by a range having a starting nucleic acid that is any of the 5' target sites or 3' target sites listed herein.

Suitable target segments can be found within a 5' UTR, a coding region, a 3' UTR, an intron, an exon, or an exon/intron junction. Target segments containing a start codon or a stop codon are also suitable target segments. A suitable target segment can specifically exclude a certain structurally defined region such as the start codon or stop codon.

The determination of suitable target segments can include a comparison of the sequence of a target nucleic acid to other sequences throughout the genome. For example, the BLAST algorithm can be used to identify regions of similarity amongst different nucleic acids. This comparison can prevent the selection of antisense compound sequences that can hybridize in a non-specific manner to sequences other than a selected target nucleic acid (i.e., non-target or off-target sequences).

There can be variation in activity (e.g., as defined by percent reduction of target nucleic acid levels) of the antisense compounds within an active target region. In certain embodiments, reductions in ANGPTL3 mRNA levels are indicative of inhibition of ANGPTL3 protein expression. Reductions in levels of an ANGPTL3 protein are also indicative of inhibition of target mRNA expression. Further, phenotypic changes, such as a reduction of the level of cholesterol, LDL, triglyceride, or glucose, can be indicative of inhibition of ANGPTL3 mRNA and/or protein expression.

Hybridization

In some embodiments, hybridization occurs between an antisense compound disclosed herein and an ANGPTL3 nucleic acid. The most common mechanism of hybridization involves hydrogen bonding (e.g., Watson-Crick, Hoogsteen or reversed Hoogsteen hydrogen bonding) between complementary nucleobases of the nucleic acid molecules.

Hybridization can occur under varying conditions. Stringent conditions are sequence-dependent and are determined by the nature and composition of the nucleic acid molecules to be hybridized.

Methods of determining whether a sequence is specifically hybridizable to a target nucleic acid are well known in the art (Sambrook and Russell, Molecular Cloning: A Laboratory Manual, 3$^{rd}$ Ed., 2001). In certain embodiments, the antisense compounds provided herein are specifically hybridizable with an ANGPTL3 nucleic acid.

Complementarity

An antisense compound and a target nucleic acid are complementary to each other when a sufficient number of nucleobases of the antisense compound can hydrogen bond with the corresponding nucleobases of the target nucleic acid, such that a desired effect will occur (e.g., antisense inhibition of a target nucleic acid, such as an ANGPTL3 nucleic acid).

An antisense compound can hybridize over one or more segments of an ANGPTL3 nucleic acid such that intervening or adjacent segments are not involved in the hybridization event (e.g., a loop structure, mismatch or hairpin structure).

In certain embodiments, the antisense compounds provided herein, or a specified portion thereof, are, or are at least, 70%, 75%, 80%, 85%, 86%, 87%, 88%, 89%, 90%, 91%, 92%, 93%, 94%, 95%, 96%, 97%, 98%, 99%, or 100% complementary to an ANGPTL3 nucleic acid, a target region, target segment, or specified portion thereof. In certain embodiments, the antisense compounds provided herein, or a specified portion thereof, are, or are at least, 70%, 75%, 80%, 85%, 86%, 87%, 88%, 89%, 90%, 91%, 92%, 93%, 94%, 95%, 96%, 97%, 98%, 99%, or 100% complementary to the sequence of one or more of SEQ ID NOs: 1-2. Percent complementarity of an antisense compound with a target nucleic acid can be determined using routine methods.

For example, an antisense compound in which 18 of 20 nucleobases of the antisense compound are complementary to a target region, and would therefore specifically hybridize, would represent 90 percent complementarity. In this example, the remaining noncomplementary nucleobases can be clustered or interspersed with complementary nucleobases and need not be contiguous to each other or to complementary nucleobases. As such, an antisense compound which is 18 nucleobases in length having 4 (four) noncomplementary nucleobases which are flanked by two regions of complete complementarity with the target nucleic acid would have 77.8% overall complementarity with the target nucleic acid and would thus fall within the scope of the present invention. Percent complementarity of an antisense compound with a region of a target nucleic acid can be determined routinely using BLAST programs (basic local alignment search tools) and PowerBLAST programs known in the art (Altschul et al., J. Mol. Biol., 1990, 215, 403 410; Zhang and Madden, Genome Res., 1997, 7, 649 656). Percent homology, sequence identity or complementarity, can be determined by, for example, the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482 489).

In certain embodiments, the antisense compounds provided herein, or specified portions thereof, are fully complementary (i.e. 100% complementary) to a target nucleic acid, or specified portion thereof. For example, an antisense compound can be fully complementary to an ANGPTL3 nucleic acid, or a target region, or a target segment or target sequence thereof. As used herein, "fully complementary" means each nucleobase of an antisense compound is capable of precise base pairing with the corresponding nucleobases of a target nucleic acid. For example, a 20 nucleobase antisense compound is fully complementary to a target sequence that is 400 nucleobases long, so long as there is a corresponding 20 nucleobase portion of the target nucleic acid that is fully complementary to the antisense compound. Fully complementary can also be used in reference to a specified portion of the first and/or the second nucleic acid. For example, a 20 nucleobase portion of a 30 nucleobase antisense compound can be "fully complementary" to a target sequence that is 400 nucleobases long. The 20 nucleobase portion of the 30 nucleobase oligonucleotide is fully complementary to the target sequence if the target sequence has a corresponding 20 nucleobase portion wherein each nucleobase is complementary to the 20 nucleobase portion of the antisense compound. At the same time, the entire 30 nucleobase antisense compound can be fully complementary to the target sequence, depending on whether the remaining 10 nucleobases of the antisense compound are also complementary to the target sequence.

The location of a non-complementary nucleobase can be at the 5' end or 3' end of the antisense compound. Alternatively, the non-complementary nucleobase or nucleobases can be at an internal position of the antisense compound. When two or more non-complementary nucleobases are present, they can be either contiguous (i.e. linked) or non-contiguous. In one embodiment, a non-complementary nucleobase is located in the wing segment of a gapmer antisense oligonucleotide.

In certain embodiments, antisense compounds that are, or are up to 10, 12, 13, 14, 15, 16, 17, 18, 19, or 20 nucleobases in length comprise no more than 4, no more than 3, no more than 2, or no more than 1 non-complementary nucleobase(s) relative to a target nucleic acid, such as an ANGPTL3 nucleic acid, or specified portion thereof.

In certain embodiments, antisense compounds that are, or are up to 10, 12, 13, 14, 15, 16, 17, 18, 19, 20, 21, 22, 23, 24, 25, 26, 27, 28, 29, or 30 nucleobases in length comprise no more than 6, no more than 5, no more than 4, no more than 3, no more than 2, or no more than 1 non-complementary nucleobase(s) relative to a target nucleic acid, such as an ANGPTL3 nucleic acid, or specified portion thereof.

The antisense compounds provided herein also include those which are complementary to a portion of a target nucleic acid. As used herein, "portion" refers to a defined number of contiguous (i.e. linked) nucleobases within a region or segment of a target nucleic acid. A "portion" can also refer to a defined number of contiguous nucleobases of an antisense compound. In certain embodiments, the antisense compounds, are complementary to at least an 8 nucleobase portion of a target segment. In certain embodiments, the antisense compounds are complementary to at least a 10 nucleobase portion of a target segment. In certain embodiments, the antisense compounds are complementary to at least a 15 nucleobase portion of a target segment. Also contemplated are antisense compounds that are complementary to at least an 8, 9, 10, 11, 12, 13, 14, 15, 16, 17, 18, 19, 20, or more nucleobase portion of a target segment, or a range defined by any two of these values.

Identity

The antisense compounds provided herein can also have a defined percent identity to a particular nucleotide sequence, SEQ ID NO, or the sequence of a compound represented by a specific Isis number, or portion thereof. As used herein, an antisense compound is identical to the sequence disclosed herein if it has the same nucleobase pairing ability. For example, a RNA which contains uracil in place of thymidine in a disclosed DNA sequence would be considered identical to the DNA sequence since both uracil and thymidine pair with adenine. Shortened and lengthened versions of the antisense compounds described herein as well as compounds having non-identical bases relative to the antisense compounds provided herein also are contemplated. The non-identical bases can be adjacent to each other or dispersed throughout the antisense compound. Percent identity of an antisense compound is calculated according to the number of bases that have identical base pairing relative to the sequence to which it is being compared.

In certain embodiments, the antisense compounds, or portions thereof, are at least 70%, 75%, 80%, 85%, 90%, 95%, 96%, 97%, 98%, 99% or 100% identical to one or more of the antisense compounds or SEQ ID NOs, or a portion thereof, disclosed herein.

Modifications

A nucleoside is a base-sugar combination. The nucleobase (also known as base) portion of the nucleoside is normally a heterocyclic base moiety. Nucleotides are nucleosides that further include a phosphate group covalently linked to the sugar portion of the nucleoside. For those nucleosides that include a pentofuranosyl sugar, the phosphate group can be linked to the 2', 3' or 5' hydroxyl moiety of the sugar. Oligonucleotides are formed through the covalent linkage of adjacent nucleosides to one another, to form a linear polymeric oligonucleotide. Within the oligonucleotide structure, the phosphate groups are commonly referred to as forming the internucleoside linkages of the oligonucleotide.

Modifications to antisense compounds encompass substitutions or changes to internucleoside linkages, sugar moieties, or nucleobases. Modified antisense compounds are often preferred over native forms because of desirable properties such as, for example, enhanced cellular uptake, enhanced affinity for nucleic acid target, increased stability in the presence of nucleases, or increased inhibitory activity.

Chemically modified nucleosides can also be employed to increase the binding affinity of a shortened or truncated antisense oligonucleotide for its target nucleic acid. Consequently, comparable results can often be obtained with shorter antisense compounds that have such chemically modified nucleosides.

Modified Internucleoside Linkages

The naturally occurring internucleoside linkage of RNA and DNA is a 3' to 5' phosphodiester linkage. Antisense compounds having one or more modified, i.e. non-naturally occurring, internucleoside linkages are often selected over antisense compounds having naturally occurring internucleoside linkages because of desirable properties such as, for example, enhanced cellular uptake, enhanced affinity for target nucleic acids, and increased stability in the presence of nucleases.

Oligonucleotides having modified internucleoside linkages include internucleoside linkages that retain a phosphorus atom as well as internucleoside linkages that do not have a phosphorus atom. Representative phosphorus containing internucleoside linkages include, but are not limited to, phosphodiesters, phosphotriesters, methylphosphonates, phosphoramidate, and phosphorothioates. Methods of preparation of phosphorous-containing and non-phosphorous-containing linkages are well known.

In certain embodiments, antisense compounds targeted to an ANGPTL3 nucleic acid comprise one or more modified internucleoside linkages. In certain embodiments, the modified internucleoside linkages are phosphorothioate linkages. In certain embodiments, each internucleoside linkage of an antisense compound is a phosphorothioate internucleoside linkage.

Modified Sugar Moieties

Antisense compounds of the invention can optionally contain one or more nucleosides wherein the sugar group has been modified. Such sugar modified nucleosides may impart enhanced nuclease stability, increased binding affinity, or some other beneficial biological property to the antisense compounds. In certain embodiments, nucleosides comprise chemically modified ribofuranose ring moieties. Examples of chemically modified ribofuranose rings include without limitation, addition of substitutent groups (including 5' and 2' substituent groups, bridging of non-geminal ring atoms to form bicyclic nucleic acids (BNA), replacement of the ribosyl ring oxygen atom with S, N(R), or $C(R_1)(R_2)$ (R, $R_1$ and $R_2$ are each independently H, $C_1$-$C_{12}$ alkyl or a protecting group) and combinations thereof. Examples of chemically modified sugars include 2'-F-5'-methyl substituted nucleoside (see PCT International Application WO 2008/101157 Published on Aug. 21, 2008 for other disclosed 5',2'-bis substituted nucleosides) or replacement of the ribosyl ring oxygen atom with S with further substitution at the 2'-position (see published U.S. Patent Application US2005-0130923, published on Jun. 16, 2005) or alternatively 5'-substitution of a BNA (see PCT International Application WO 2007/134181 Published on Nov. 22, 2007 wherein LNA is substituted with for example a 5'-methyl or a 5'-vinyl group).

Examples of nucleosides having modified sugar moieties include without limitation nucleosides comprising 5'-vinyl, 5'-methyl (R or S), 4'-S, 2'-F, 2'-OCH$_3$, 2'—OCH$_2$CH$_3$, 2'-OCH$_2$CH$_2$F and 2'-O(CH$_2$)$_2$OCH$_3$ substituent groups. The substituent at the 2' position can also be selected from allyl, amino, azido, thio, O-allyl, O—C$_1$-C$_{10}$ alkyl, OCF$_3$, OCH$_2$F, O(CH$_2$)$_2$SCH$_3$, O(CH$_2$)$_2$—O—N(R$_m$)(R$_n$), O—CH$_2$—C(=O)—N(R$_m$)(R$_n$), and O—CH$_2$—C(=O)—N(R$_l$)—(CH$_2$)$_2$—N(R$_m$)(R$_n$), where each R$_l$, R$_m$ and R$_n$ is, independently, H or substituted or unsubstituted C$_1$-C$_{10}$ alkyl.

As used herein, "bicyclic nucleosides" refer to modified nucleosides comprising a bicyclic sugar moiety. Examples of bicyclic nucleic acids (BNAs) include without limitation nucleosides comprising a bridge between the 4' and the 2' ribosyl ring atoms. In certain embodiments, antisense compounds provided herein include one or more BNA nucleosides wherein the bridge comprises one of the formulas: 4'-(CH$_2$)—O-2' (LNA); 4'-(CH$_2$)—S-2; 4'-(CH$_2$)$_2$—O-2' (ENA); 4'-CH(CH$_3$)—O-2' and 4'-CH(CH$_2$OCH$_3$)—O-2' (and analogs thereof see U.S. Pat. No. 7,399,845, issued on Jul. 15, 2008); 4'-C(CH$_3$)(CH$_3$)—O-2' (and analogs thereof see PCT/US2008/068922 published as WO/2009/006478, published Jan. 8, 2009); 4'-CH$_2$—N(OCH$_3$)-2' (and analogs thereof see PCT/US2008/064591 published as WO/2008/150729, published Dec. 11, 2008); 4'-CH$_2$—O—N(CH$_3$)-2' (see published U.S. Patent Application US2004-0171570, published Sep. 2, 2004); 4'-CH$_2$—N(R)—O-2', wherein R is H, C$_1$-C$_{12}$ alkyl, or a protecting group (see U.S. Pat. No. 7,427,672, issued on Sep. 23, 2008); 4'-CH$_2$—C(H)(CH$_3$)-2' (see Chattopadhyaya et al., *J. Org. Chem.*, 2009, 74, 118-134); and 4'-CH$_2$—C(=CH$_2$)-2' (and analogs thereof see PCT/US2008/066154 published as WO 2008/154401, published on Dec. 8, 2008).

Further bicyclic nucleosides have been reported in published literature (see for example: Srivastava et al., *J. Am. Chem. Soc.*, 2007, 129(26) 8362-8379; Frieden et al., *Nucleic Acids Research*, 2003, 21, 6365-6372; Elayadi et al., *Curr. Opinion Invens. Drugs*, 2001, 2, 558-561; Braasch et al., *Chem. Biol.*, 2001, 8, 1-7; Orum et al., *Curr. Opinion Mol. Ther.*, 2001, 3, 239-243; Wahlestedt et al., *Proc. Natl. Acad. Sci. U S. A.*, 2000, 97, 5633-5638; Singh et al., *Chem. Commun.*, 1998, 4, 455-456; Koshkin et al., *Tetrahedron*, 1998, 54, 3607-3630; Kumar et al., *Bioorg. Med. Chem. Lett.*, 1998, 8, 2219-2222; Singh et al., *J. Org. Chem.*, 1998, 63, 10035-10039; U.S. Pat. Nos. 7,399,845; 7,053,207; 7,034,133; 6,794,499; 6,770,748; 6,670,461; 6,525,191; 6,268,490; U.S. Patent Publication Nos.: US2008-0039618; US2007-0287831; US2004-0171570; U.S. patent application Ser. Nos. 12/129,154; 61/099,844; 61/097,787; 61/086,231; 61/056,564; 61/026,998; 61/026,995; 60/989,574; International applications WO 2007/134181; WO 2005/021570; WO 2004/106356; WO 94/14226; and PCT International Applications Nos.: PCT/US2008/068922; PCT/US-2008/066154; and PCT/US2008/064591). Each of the foregoing bicyclic nucleosides can be prepared having one or more stereochemical sugar configurations including for example α-L-ribofuranose and β-D-ribofuranose (see PCT international application PCT/DK98/00393, published on Mar. 25, 1999 as WO 99/14226).

As used herein, "monocylic nucleosides" refer to nucleosides comprising modified sugar moieties that are not bicyclic sugar moieties. In certain embodiments, the sugar moiety, or sugar moiety analogue, of a nucleoside may be modified or substituted at any position.

As used herein, "4'-2' bicyclic nucleoside" or "4' to 2' bicyclic nucleoside" refers to a bicyclic nucleoside comprising a furanose ring comprising a bridge connecting two carbon atoms of the furanose ring connects the 2' carbon atom and the 4' carbon atom of the sugar ring.

In certain embodiments, bicyclic sugar moieties of BNA nucleosides include, but are not limited to, compounds having at least one bridge between the 4' and the 2' carbon atoms of the pentofuranosyl sugar moiety including without limitation, bridges comprising 1 or from 1 to 4 linked groups independently selected from —[C(R$_a$)(R$_b$)]$_n$—, —C(R$_a$)=C(R$_b$)—, —C(R$_a$)=N—, —C(=NR$_a$)—, —C(=O)—, —C(=S)—, —O—, —Si(R$_a$)$_2$—, —S(=O)$_x$—, and —N(R$_a$)—; wherein: x is 0, 1, or 2; n is 1, 2, 3, or 4; each R$_a$ and R$_b$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, heterocycle radical, substituted heterocycle radical, heteroaryl, substituted heteroaryl, C$_5$-C$_7$ alicyclic radical, substituted C$_5$-C$_7$ alicyclic radical, halogen, OJ$_1$, NJ$_1$J$_2$, SJ$_1$, N$_3$, COOJ$_1$, acyl (C(=O)—H), substituted acyl, CN, sulfonyl (S(=O)$_2$-J$_1$), or sulfoxyl (S(=O)-J$_1$); and each J$_1$ and J$_2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(=O)—H), substituted acyl, a heterocycle radical, a substituted heterocycle radical, C$_1$-C$_{12}$ aminoalkyl, substituted C$_1$-C$_{12}$ aminoalkyl or a protecting group.

In certain embodiments, the bridge of a bicyclic sugar moiety is, —[C(R$_a$)(R$_b$)]$_n$—, —[C(R$_a$)(R$_b$)]$_n$—O—, —C(R$_a$R$_b$)—N(R)—O— or —C(R$_a$R$_b$)—O—N(R)—. In certain embodiments, the bridge is 4'-CH$_2$-2', 4'-(CH$_2$)$_2$-2', 4'-(CH$_2$)$_3$-2', 4'-CH$_2$—O-2', 4'-(CH$_2$)$_2$—O-2', 4'-CH$_2$—O—N(R)-2' and 4'-CH$_2$—N(R)—O-2'- wherein each R is, independently, H, a protecting group or C$_1$-C$_{12}$ alkyl.

In certain embodiments, bicyclic nucleosides are further defined by isomeric configuration. For example, a nucleoside comprising a 4'-(CH$_2$)—O-2' bridge, may be in the α-L configuration or in the β-D configuration. Previously, α-L-methyleneoxy (4'-CH$_2$—O-2') BNA's have been incorporated into antisense oligonucleotides that showed antisense activity (Frieden et al., Nucleic Acids Research, 2003, 21, 6365-6372).

In certain embodiments, bicyclic nucleosides include those having a 4' to 2' bridge wherein such bridges include without limitation, α-L-4'-(CH$_2$)—O-2', β-D-4'-CH$_2$—O-2', 4'-(CH$_2$)$_2$—O-2', 4'-CH$_2$—O—N(R)-2', 4'-CH$_2$—N(R)—O-2', 4'-CH(CH$_3$)—O-2', 4'-CH$_2$—S-2', 4'-CH$_2$—N(R)-2', 4'-CH$_2$—CH(CH$_3$)-2', and 4'-(CH$_2$)$_3$-2', wherein R is H, a protecting group or C$_1$-C$_{12}$ alkyl.

In certain embodiment, bicyclic nucleosides have the formula:

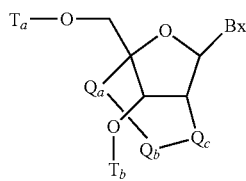

wherein:

Bx is a heterocyclic base moiety;

-$Q_a$-$Q_b$-$Q_c$- is —$CH_2$—N($R_c$)—$CH_2$—, —C(=O)—N($R_c$)—$CH_2$—, —$CH_2$—O—N($R_c$)—, —$CH_2$—N($R_c$)—O— or —N($R_c$)—O—$CH_2$;

$R_c$ is $C_1$-$C_{12}$ alkyl or an amino protecting group; and $T_a$ and $T_b$ are each, independently H, a hydroxyl protecting group, a conjugate group, a reactive phosphorus group, a phosphorus moiety or a covalent attachment to a support medium.

In certain embodiments, bicyclic nucleosides have the formula:

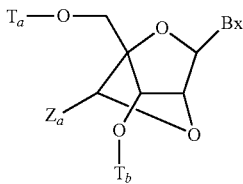

wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

$Z_a$ is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl, acyl, substituted acyl, substituted amide, thiol or substituted thiol.

In one embodiment, each of the substituted groups, is, independently, mono or poly substituted with substituent groups independently selected from halogen, oxo, hydroxyl, $OJ_c$, $NJ_cJ_d$, $SJ_c$, $N_3$, OC(=X)$J_c$, and $NJ_eC$(=X)$NJ_cJ_d$, wherein each $J_c$, $J_d$ and $J_e$ is, independently, H, $C_1$-$C_6$ alkyl, or substituted $C_1$-$C_6$ alkyl and X is O or $NJ_c$.

In certain embodiments, bicyclic nucleosides have the formula:

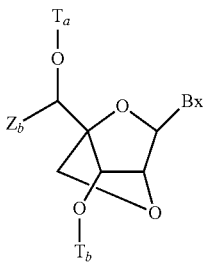

wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

$Z_b$ is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl or substituted acyl (C(=O)—).

In certain embodiments, bicyclic nucleosides have the formula:

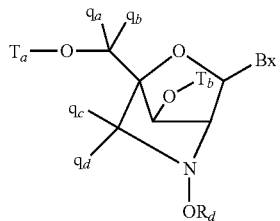

wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

$R_d$ is $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl or substituted $C_2$-$C_6$ alkynyl;

each $q_a$, $q_b$, $q_c$ and $q_d$ is, independently, H, halogen, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl or substituted $C_2$-$C_6$ alkynyl, $C_1$-$C_6$ alkoxyl, substituted $C_1$-$C_6$ alkoxyl, acyl, substituted acyl, $C_1$-$C_6$ aminoalkyl or substituted $C_1$-$C_6$ aminoalkyl; In certain embodiments, bicyclic nucleosides have the formula:

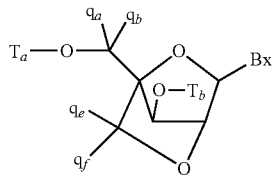

wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

$q_a$, $q_b$, $q_e$ and $q_f$ are each, independently, hydrogen, halogen, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_1$-$C_{12}$ alkoxy, substituted $C_1$-$C_{12}$ alkoxy, $OJ_j$, $SJ_j$, $SOJ_j$, $SO_2J_j$, $NJ_jJ_k$, $N_3$, CN, C(=O)$OJ_j$, C(=O)$NJ_jJ_k$, C(=O)$J_j$, O—C(=O)$NJ_jJ_k$, N(H)C(=NH)$NJ_jJ_k$, N(H)C(=O)$NJ_jJ_k$ or N(H)C(=S)$NJ_jJ_k$;

or $q_e$ and $q_f$ together are =C($q_g$)($q_h$);

$q_g$ and $q_h$ are each, independently, H, halogen, $C_1$-$C_{12}$ alkyl or substituted $C_1$-$C_{12}$ alkyl.

The synthesis and preparation of adenine, cytosine, guanine, 5-methyl-cytosine, thymine and uracil bicyclic nucleosides having a 4'—$CH_2$—O-2' bridge, along with their oligomerization, and nucleic acid recognition properties have been described (Koshkin et al., *Tetrahedron*, 1998, 54, 3607-3630). The synthesis of bicyclic nucleosides has also been described in WO 98/39352 and WO 99/14226.

Analogs of various bicyclic nucleosides that have 4' to 2' bridging groups such as 4'—$CH_2$—O-2' and 4'—$CH_2$—S-2', have also been prepared (Kumar et al., *Bioorg. Med. Chem. Lett.*, 1998, 8, 2219-2222). Preparation of oligodeoxyribonucleotide duplexes comprising bicyclic nucleosides for use as substrates for nucleic acid polymerases has also been described (Wengel et al., WO 99/14226). Furthermore, synthesis of 2′-amino-BNA, a novel conformationally restricted high-affinity oligonucleotide analog has been described in the art (Singh et al., *J. Org. Chem.*, 1998, 63, 10035-10039). In addition, 2′-amino- and 2′-methylamino-BNA's have been prepared and the thermal stability of their duplexes with complementary RNA and DNA strands has been previously reported.

In certain embodiments, bicyclic nucleosides have the formula:

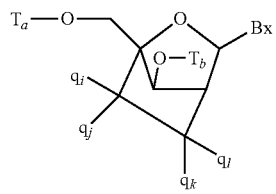

wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

each $q_i$, $q_j$, $q_k$ and $q_l$ is, independently, H, halogen, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_1$-$C_{12}$ alkoxyl, substituted $C_1$-$C_{12}$ alkoxyl, $OJ_j$, $SJ_j$, $SOJ_j$, $SO_2J_j$, $NJ_jJ_k$, $N_3$, CN, C(=O)$OJ_j$, C(=O)$NJ_jJ_k$, C(=O)$J_j$, O—C(=O)$NJ_jJ_k$, N(H)C(=NH)$NJ_jJ_k$, N(H)C(=O)$NJ_jJ_k$ or N(H)C(=S)$NJ_jJ_k$; and $q_i$ and $q_j$ or $q_l$ and $q_k$ together are =C($q_g$)($q_h$), wherein $q_g$ and $q_h$ are each, independently, H, halogen, $C_1$-$C_{12}$ alkyl or substituted $C_1$-$C_{12}$ alkyl.

One carbocyclic bicyclic nucleoside having a 4′-(CH$_2$)$_3$-2′ bridge and the alkenyl analog bridge 4′—CH=CH—CH$_2$—2′ have been described (Frier et al., *Nucleic Acids Research*, 1997, 25(22), 4429-4443 and Albaek et al., *J. Org. Chem.*, 2006, 71, 7731-7740). The synthesis and preparation of carbocyclic bicyclic nucleosides along with their oligomerization and biochemical studies have also been described (Srivastava et al., *J. Am. Chem. Soc.* 2007, 129(26), 8362-8379).

In certain embodiments, bicyclic nucleosides include, but are not limited to, (A) α-L-methyleneoxy (4′—CH$_2$—O-2′) BNA, (B) β-D-methyleneoxy (4′—CH$_2$—O-2′) BNA, (C) ethyleneoxy (4′-(CH$_2$)$_2$—O-2′) BNA, (D) aminooxy (4′—CH$_2$—O—N(R)-2′) BNA, (E) oxyamino (4′—CH$_2$—N(R)—O-2′) BNA, (F) methyl(methyleneoxy) (4′—CH(CH$_3$)—O-2′) BNA (also referred to as constrained ethyl or cEt), (G) methylene-thio (4′—CH$_2$—S-2′) BNA, (H) methylene-amino (4′—CH$_2$—N(R)-2′) BNA, (I) methyl carbocyclic (4′—CH$_2$—CH(CH$_3$)-2′) BNA, (J) propylene carbocyclic (4′-(CH$_2$)$_3$-2′) BNA, and (K) vinyl BNA as depicted below.

(A)

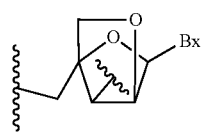

(B)

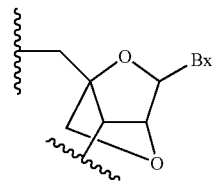

(C)

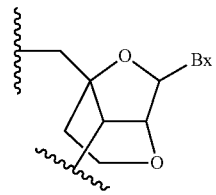

(D)

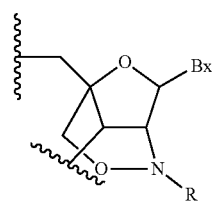

(E)

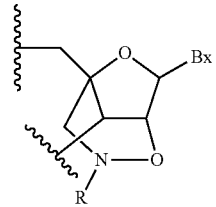

(F)

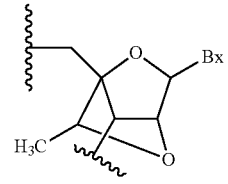

(G)

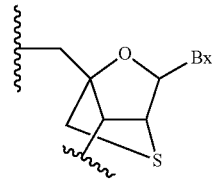

(H)

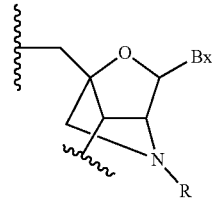

(I)

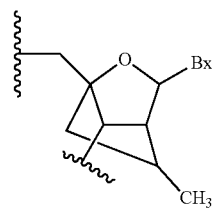

-continued

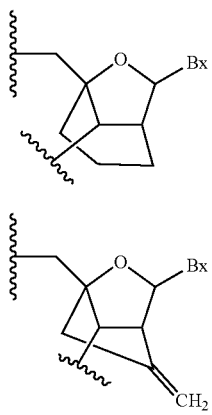

wherein Bx is the base moiety and R is, independently, H, a protecting group, $C_1$-$C_6$ alkyl or $C_1$-$C_6$ alkoxy.

As used herein, the term "modified tetrahydropyran nucleoside" or "modified THP nucleoside" means a nucleoside having a six-membered tetrahydropyran "sugar" substituted for the pentofuranosyl residue in normal nucleosides and can be referred to as a sugar surrogate. Modified THP nucleosides include, but are not limited to, what is referred to in the art as hexitol nucleic acid (HNA), anitol nucleic acid (ANA), manitol nucleic acid (MNA) (see Leumann, *Bioorg. Med. Chem.*, 2002, 10, 841-854) or fluoro HNA (F-HNA) having a tetrahydropyranyl ring system as illustrated below.

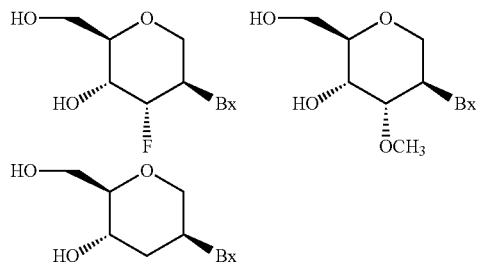

In certain embodiment, sugar surrogates are selected having the formula:

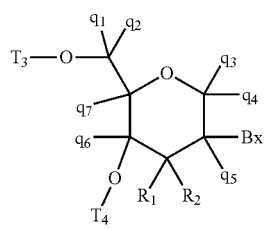

wherein:

Bx is a heterocyclic base moiety;

$T_3$ and $T_4$ are each, independently, an internucleoside linking group linking the tetrahydropyran nucleoside analog to the oligomeric compound or one of $T_3$ and $T_4$ is an internucleoside linking group linking the tetrahydropyran nucleoside analog to an oligomeric compound or oligonucleotide and the other of $T_3$ and $T_4$ is H, a hydroxyl protecting group, a linked conjugate group or a 5' or 3'-terminal group;

$q_1$, $q_2$, $q_3$, $q_4$, $q_5$, $q_6$ and $q_7$ are each independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl or substituted $C_2$-$C_6$ alkynyl; and one of $R_1$ and $R_2$ is hydrogen and the other is selected from halogen, substituted or unsubstituted alkoxy, $NJ_1J_2$, $SJ_1$, $N_3$, $OC(=X)J_1$, $OC(=X)NJ_1J_2$, $NJ_3C(=X)NJ_1J_2$ and CN, wherein X is O, S or $NJ_1$ and each $J_1$, $J_2$ and $J_3$ is, independently, H or $C_1$-$C_6$ alkyl.

In certain embodiments, $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, THP nucleosides are provided wherein one of $R_1$ and $R_2$ is F. In certain embodiments, $R_1$ is fluoro and $R_2$ is H; $R_1$ is methoxy and $R_2$ is H, and $R_1$ is methoxyethoxy and $R_2$ is H.

In certain embodiments, sugar surrogates comprise rings having more than 5 atoms and more than one heteroatom. For example nucleosides comprising morpholino sugar moieties and their use in oligomeric compounds has been reported (see for example: Braasch et al., *Biochemistry*, 2002, 41, 4503-4510; and U.S. Pat. Nos. 5,698,685; 5,166,315; 5,185,444; and 5,034,506). As used here, the term "morpholino" means a sugar surrogate having the following formula:

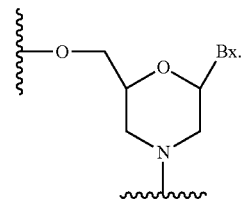

In certain embodiments, morpholinos may be modified, for example by adding or altering various substituent groups from the above morpholino structure. Such sugar surrogates are referred to herein as "modified morpholinos."

Combinations of modifications are also provided without limitation, such as 2'-F-5'-methyl substituted nucleosides (see PCT International Application WO 2008/101157 published on Aug. 21, 2008 for other disclosed 5', 2'-bis substituted nucleosides) and replacement of the ribosyl ring oxygen atom with S and further substitution at the 2'-position (see published U.S. Patent Application US2005-0130923, published on Jun. 16, 2005) or alternatively 5'-substitution of a bicyclic nucleic acid (see PCT International Application WO 2007/134181, published on Nov. 22, 2007 wherein a 4'—$CH_2$—O-2' bicyclic nucleoside is further substituted at the 5' position with a 5'-methyl or a 5'-vinyl group). The synthesis and preparation of carbocyclic bicyclic nucleosides along with their oligomerization and biochemical studies have also been described (see, e.g., Srivastava et al., *J. Am. Chem. Soc.* 2007, 129(26), 8362-8379).

In certain embodiments, antisense compounds comprise one or more modified cyclohexenyl nucleosides, which is a nucleoside having a six-membered cyclohexenyl in place of the pentofuranosyl residue in naturally occurring nucleosides. Modified cyclohexenyl nucleosides include, but are not limited to those described in the art (see for example commonly owned, published PCT Application WO 2010/036696, published on Apr. 10, 2010, Robeyns et al., *J. Am. Chem. Soc.*, 2008, 130(6), 1979-1984; Horvath et al., *Tetrahedron Letters*, 2007, 48, 3621-3623; Nauwelaerts et al., J. Am. Chem. Soc., 2007, 129(30), 9340-9348; Gu et al., Nucleosides, Nucleotides & Nucleic Acids, 2005, 24(5-7), 993-998; Nauwelaerts et al., Nucleic Acids Research, 2005, 33(8), 2452-2463; Robeyns et al., Acta Crystallographica, Section F: Structural Biology and Crystallization Communications, 2005, F61(6), 585-586; Gu et al., Tetrahedron, 2004, 60(9), 2111-2123; Gu et al., Oligonucleotides, 2003, 13(6), 479-489; Wang et al., J. Org. Chem., 2003, 68, 4499-4505; Verbeure et al., Nucleic Acids Research, 2001, 29(24), 4941-4947; Wang et al., J Org. Chem., 2001, 66, 8478-82; Wang et al., Nucleosides, Nucleotides & Nucleic Acids, 2001, 20(4-7), 785-788; Wang et al., J Am. Chem., 2000, 122, 8595-8602; Published PCT application, WO 06/047842; and Published PCT Application WO 01/049687; the text of each is incorporated by reference herein, in their entirety). Certain modified cyclohexenyl nucleosides have Formula X.

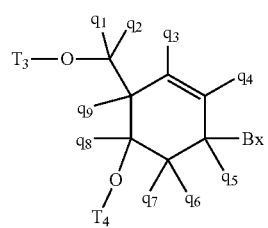

X wherein independently for each of said at least one cyclohexenyl nucleoside analog of Formula X:

Bx is a heterocyclic base moiety;

$T_3$ and $T_4$ are each, independently, an internucleoside linking group linking the cyclohexenyl nucleoside analog to an antisense compound or one of $T_3$ and $T_4$ is an internucleoside linking group linking the tetrahydropyran nucleoside analog to an antisense compound and the other of $T_3$ and $T_4$ is H, a hydroxyl protecting group, a linked conjugate group, or a 5'- or 3'-terminal group; and $q_1$, $q_2$, $q_3$, $q_4$, $q_5$, $q_6$, $q_7$, $q_8$ and $q_9$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, substituted $C_2$-$C_6$ alkynyl or other sugar substituent group.

Many other monocyclic, bicyclic and tricyclic ring systems are known in the art and are suitable as sugar surrogates that can be used to modify nucleosides for incorporation into oligomeric compounds as provided herein (see for example review article: Leumann, Christian J. Bioorg. & Med. Chem., 2002, 10, 841-854). Such ring systems can undergo various additional substitutions to further enhance their activity.

As used herein, "2'-modified sugar" means a furanosyl sugar modified at the 2' position. In certain embodiments, such modifications include substituents selected from: a halide, including, but not limited to substituted and unsubstituted alkoxy, substituted and unsubstituted thioalkyl, substituted and unsubstituted amino alkyl, substituted and unsubstituted alkyl, substituted and unsubstituted allyl, and substituted and unsubstituted alkynyl. In certain embodiments, 2' modifications are selected from substituents including, but not limited to: O[(CH$_2$)$_n$O]$_m$CH$_3$, O(CH$_2$)$_n$NH$_2$, O(CH$_2$)$_n$CH$_3$, O(CH$_2$)$_n$F, O(CH$_2$)$_n$ONH$_2$, OCH$_2$C(=O)N(H)CH$_3$, and O(CH$_2$)$_n$ON[(CH$_2$)$_n$CH$_3$]$_2$, where n and m are from 1 to about 10. Other 2'-substituent groups can also be selected from: $C_1$-$C_{12}$ alkyl, substituted alkyl, alkenyl, alkynyl, alkaryl, aralkyl, O-alkaryl or O-aralkyl, SH, SCH$_3$, OCN, Cl, Br, CN, F, CF$_3$, OCF$_3$, SOCH$_3$, SO$_2$CH$_3$, ONO$_2$, NO$_2$, N$_3$, NH$_2$, heterocycloalkyl, heterocycloalkaryl, aminoalkylamino, polyalkylamino, substituted silyl, an RNA cleaving group, a reporter group, an intercalator, a group for improving pharmacokinetic properties, or a group for improving the pharmacodynamic properties of an antisense compound, and other substituents having similar properties. In certain embodiments, modified nucleosides comprise a 2'-MOE side chain (Baker et al., J Biol. Chem., 1997, 272, 11944-12000). Such 2'-MOE substitution have been described as having improved binding affinity compared to unmodified nucleosides and to other modified nucleosides, such as 2'-O-methyl, O-propyl, and O-aminopropyl. Oligonucleotides having the 2'-MOE substituent also have been shown to be antisense inhibitors of gene expression with promising features for in vivo use (Martin, Helv. Chim. Acta, 1995, 78, 486-504; Altmann et al., Chimia, 1996, 50, 168-176; Altmann et al., Biochem. Soc. Trans., 1996, 24, 630-637; and Altmann et al., Nucleosides Nucleotides, 1997, 16, 917-926).

As used herein, "2'-modified" or "2'-substituted" refers to a nucleoside comprising a sugar comprising a substituent at the 2' position other than H or OH. 2'-modified nucleosides, include, but are not limited to, bicyclic nucleosides wherein the bridge connecting two carbon atoms of the sugar ring connects the 2' carbon and another carbon of the sugar ring; and nucleosides with non-bridging 2'substituents, such as allyl, amino, azido, thio, O-allyl, O—$C_1$-$C_{10}$ alkyl, —OCF$_3$, O—(CH$_2$)$_2$—O—CH$_3$, 2'-O(CH$_2$)$_2$SCH$_3$, O—(CH$_2$)$_2$—O—N(R$_m$)(R$_n$), or O—CH$_2$—C(=O)—N(R$_m$)(R$_n$), where each R$_m$ and R$_n$ is, independently, H or substituted or unsubstituted $C_1$-$C_{10}$ alkyl. 2'-modified nucleosides may further comprise other modifications, for example at other positions of the sugar and/or at the nucleobase.

As used herein, "2'-F" refers to a nucleoside comprising a sugar comprising a fluoro group at the 2' position of the sugar ring.

As used herein, "2'-OMe" or "2'-OCH$_3$", "2'-O-methyl" or "2'-methoxy" each refers to a nucleoside comprising a sugar comprising an —OCH$_3$ group at the 2' position of the sugar ring.

As used herein, "MOE" or "2'-MOE" or "2'-OCH$_2$CH$_2$OCH$_3$" or "2'-O-methoxyethyl" each refers to a nucleoside comprising a sugar comprising a —OCH$_2$CH$_2$OCH$_3$ group at the 2' position of the sugar ring.

Methods for the preparations of modified sugars are well known to those skilled in the art. Some representative U.S. patents that teach the preparation of such modified sugars include without limitation, U.S. Pat. Nos. 4,981,957; 5,118, 800; 5,319,080; 5,359,044; 5,393,878; 5,446,137; 5,466, 786; 5,514,785; 5,519,134; 5,567,811; 5,576,427; 5,591, 722; 5,597,909; 5,610,300; 5,627,053; 5,639,873; 5,646, 265; 5,670,633; 5,700,920; 5,792,847 and 6,600,032 and International Application PCT/US2005/019219, filed Jun. 2, 2005 and published as WO 2005/121371 on Dec. 22, 2005, and each of which is herein incorporated by reference in its entirety.

As used herein, "oligonucleotide" refers to a compound comprising a plurality of linked nucleosides. In certain embodiments, one or more of the plurality of nucleosides is modified. In certain embodiments, an oligonucleotide comprises one or more ribonucleosides (RNA) and/or deoxyribonucleosides (DNA).

In nucleotides having modified sugar moieties, the nucleobase moieties (natural, modified or a combination thereof) are maintained for hybridization with an appropriate nucleic acid target.

In certain embodiments, antisense compounds comprise one or more nucleosides having modified sugar moieties. In certain embodiments, the modified sugar moiety is 2'-MOE. In certain embodiments, the 2'-MOE modified nucleosides are arranged in a gapmer motif. In certain embodiments, the modified sugar moiety is a bicyclic nucleoside having a (4'—CH(CH$_3$)—O-2') bridging group. In certain embodiments, the (4'—CH(CH$_3$)—O-2') modified nucleosides are arranged throughout the wings of a gapmer motif.

Modified Nucleobases

Nucleobase (or base) modifications or substitutions are structurally distinguishable from, yet functionally interchangeable with, naturally occurring or synthetic unmodified nucleobases. Both natural and modified nucleobases are capable of participating in hydrogen bonding. Such nucleobase modifications can impart nuclease stability, binding affinity or some other beneficial biological property to antisense compounds. Modified nucleobases include synthetic and natural nucleobases such as, for example, 5-methylcytosine (5-me-C). Certain nucleobase substitutions, including 5-methylcytosine substitutions, are particularly useful for increasing the binding affinity of an antisense compound for a target nucleic acid. For example, 5-methylcytosine substitutions have been shown to increase nucleic acid duplex stability by 0.6-1.2° C. (Sanghvi, Y. S., Crooke, S. T. and Lebleu, B., eds., Antisense Research and Applications, CRC Press, Boca Raton, 1993, pp. 276-278).

Additional modified nucleobases include 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl (—C≡C—CH3) uracil and cytosine and other alkynyl derivatives of pyrimidine bases, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 2-F-adenine, 2-amino-adenine, 8-azaguanine and 8-azaadenine, 7-deazaguanine and 7-deazaadenine and 3-deazaguanine and 3-deazaadenine.

Heterocyclic base moieties can also include those in which the purine or pyrimidine base is replaced with other heterocycles, for example 7-deaza-adenine, 7-deazaguanosine, 2-aminopyridine and 2-pyridone. Nucleobases that are particularly useful for increasing the binding affinity of antisense compounds include 5-substituted pyrimidines, 6-azapyrimidines and N-2, N-6 and O-6 substituted purines, including 2 aminopropyladenine, 5-propynyluracil and 5-propynylcytosine.

In certain embodiments, antisense compounds targeted to an ANGPTL3 nucleic acid comprise one or more modified nucleobases. In certain embodiments, shortened or gap-widened antisense oligonucleotides targeted to an ANGPTL3 nucleic acid comprise one or more modified nucleobases. In certain embodiments, the modified nucleobase is 5-methylcytosine. In certain embodiments, each cytosine is a 5-methylcytosine.

Compositions and Methods for Formulating Pharmaceutical Compositions

Antisense oligonucleotides can be admixed with pharmaceutically acceptable active or inert substance for the preparation of pharmaceutical compositions or formulations. Compositions and methods for the formulation of pharmaceutical compositions are dependent upon a number of criteria, including, but not limited to, route of administration, extent of disease, or dose to be administered.

Antisense compound targeted to an ANGPTL3 nucleic acid can be utilized in pharmaceutical compositions by combining the antisense compound with a suitable pharmaceutically acceptable diluent or carrier. A pharmaceutically acceptable diluent includes phosphate-buffered saline (PBS). PBS is a diluent suitable for use in compositions to be delivered parenterally. Accordingly, in one embodiment, employed in the methods described herein is a pharmaceutical composition comprising an antisense compound targeted to an ANGPTL3 nucleic acid and a pharmaceutically acceptable diluent. In certain embodiments, the pharmaceutically acceptable diluent is PBS. In certain embodiments, the antisense compound is an antisense oligonucleotide.

Pharmaceutical compositions comprising antisense compounds encompass any pharmaceutically acceptable salts, esters, or salts of such esters, or any other oligonucleotide which, upon administration to an animal, including a human, is capable of providing (directly or indirectly) the biologically active metabolite or residue thereof. Accordingly, for example, the disclosure is also drawn to pharmaceutically acceptable salts of antisense compounds, prodrugs, pharmaceutically acceptable salts of such prodrugs, and other bioequivalents. Suitable pharmaceutically acceptable salts include, but are not limited to, sodium and potassium salts.

A prodrug can include the incorporation of additional nucleosides at one or both ends of an antisense compound which are cleaved by endogenous nucleases within the body, to form the active antisense compound.

Conjugated Antisense Compounds

Antisense compounds can be covalently linked to one or more moieties or conjugates which enhance the activity, cellular distribution or cellular uptake of the resulting antisense oligonucleotides. Typical conjugate groups include cholesterol moieties and lipid moieties. Additional conjugate groups include carbohydrates, phospholipids, biotin, phenazine, folate, phenanthridine, anthraquinone, acridine, fluoresceins, rhodamines, coumarins, and dyes.

Antisense compounds can also be modified to have one or more stabilizing groups that are generally attached to one or both termini of antisense compounds to enhance properties such as, for example, nuclease stability. Included in stabilizing groups are cap structures. These terminal modifications protect the antisense compound having terminal nucleic acids from exonuclease degradation, and can help in delivery and/or localization within a cell. The cap can be present at the 5'-terminus (5'-cap), or at the 3'-terminus (3'-cap), or can be present on both termini. Cap structures are well known in the art and include, for example, inverted deoxy abasic caps. Further 3' and 5'-stabilizing groups that can be used to cap one or both ends of an antisense compound to impart nuclease stability include those disclosed in WO 03/004602 published on Jan. 16, 2003.

Cell Culture and Antisense Compounds Treatment

The effects of antisense compounds on the level, activity or expression of ANGPTL3 nucleic acids can be tested in vitro in a variety of cell types. Cell types used for such analyses are available from commercial vendors (e.g. American Type Culture Collection, Manassas, Va.; Zen-Bio, Inc., Research Triangle Park, N.C.; Clonetics Corporation, Walkersville, Md.) and cells are cultured according to the vendor's instructions using commercially available reagents (e.g. Invitrogen Life Technologies, Carlsbad, Calif.). Illustrative cell types include, but are not limited to, HepG2 cells, Hep3B cells, Huh7 (hepatocellular carcinoma) cells, primary hepatocytes, A549 cells, GM04281 fibroblasts and LLC-MK2 cells.

In Vitro Testing of Antisense Oligonucleotides

Described herein are methods for treatment of cells with antisense oligonucleotides, which can be modified appropriately for treatment with other antisense compounds.

In general, cells are treated with antisense oligonucleotides when the cells reach approximately 60-80% confluence in culture.

One reagent commonly used to introduce antisense oligonucleotides into cultured cells includes the cationic lipid transfection reagent LIPOFECTIN® (Invitrogen, Carlsbad, Calif.). Antisense oligonucleotides are mixed with LIPOFECTIN® in OPTI-MEM® 1 (Invitrogen, Carlsbad, Calif.) to achieve the desired final concentration of antisense oligonucleotide and a LIPOFECTIN® concentration that typically ranges 2 to 12 ug/mL per 100 nM antisense oligonucleotide.

Another reagent used to introduce antisense oligonucleotides into cultured cells includes LIPOFECTAMINE 2000® (Invitrogen, Carlsbad, Calif.). Antisense oligonucleotide is mixed with LIPOFECTAMINE 2000® in OPTI-MEM® 1 reduced serum medium (Invitrogen, Carlsbad, Calif.) to achieve the desired concentration of antisense oligonucleotide and a LIPOFECTAMINE® concentration that typically ranges 2 to 12 ug/mL per 100 nM antisense oligonucleotide.

Another reagent used to introduce antisense oligonucleotides into cultured cells includes Cytofectin® (Invitrogen, Carlsbad, Calif.). Antisense oligonucleotide is mixed with Cytofectin® in OPTI-MEM® 1 reduced serum medium (Invitrogen, Carlsbad, Calif.) to achieve the desired concentration of antisense oligonucleotide and a Cytofectin® concentration that typically ranges 2 to 12 ug/mL per 100 nM antisense oligonucleotide.

Another reagent used to introduce antisense oligonucleotides into cultured cells includes Oligofectamine™ (Invitrogen Life Technologies, Carlsbad, Calif.). Antisense oligonucleotide is mixed with Oligofectamine™ in Opti-MEM™-1 reduced serum medium (Invitrogen Life Technologies, Carlsbad, Calif.) to achieve the desired concentration of oligonucleotide with an Oligofectamine™ to oligonucleotide ratio of approximately 0.2 to 0.8 µL per 100 nM.

Another reagent used to introduce antisense oligonucleotides into cultured cells includes FuGENE 6 (Roche Diagnostics Corp., Indianapolis, Ind.). Antisense oligomeric compound was mixed with FuGENE 6 in 1 mL of serum-free RPMI to achieve the desired concentration of oligonucleotide with a FuGENE 6 to oligomeric compound ratio of 1 to 4 µL of FuGENE 6 per 100 nM.

Another technique used to introduce antisense oligonucleotides into cultured cells includes electroporation (Sambrook and Russell, Molecular Cloning: A Laboratory Manual, $3^{rd}$ Ed., 2001).

Cells are treated with antisense oligonucleotides by routine methods. Cells are typically harvested 16-24 hours after antisense oligonucleotide treatment, at which time RNA or protein levels of target nucleic acids are measured by methods known in the art and described herein. In general, when treatments are performed in multiple replicates, the data are presented as the average of the replicate treatments.

The concentration of antisense oligonucleotide used varies from cell line to cell line. Methods to determine the optimal antisense oligonucleotide concentration for a particular cell line are well known in the art. Antisense oligonucleotides are typically used at concentrations ranging from 1 nM to 300 nM when transfected with LIPOFECTAMINE2000®, Lipofectin or Cytofectin. Antisense oligonucleotides are used at higher concentrations ranging from 625 to 20,000 nM when transfected using electroporation.

RNA Isolation

RNA analysis can be performed on total cellular RNA or poly(A)+mRNA. Methods of RNA isolation are well known in the art (Sambrook and Russell, Molecular Cloning: A Laboratory Manual, $3^{rd}$ Ed., 2001). RNA is prepared using methods well known in the art, for example, using the TRIZOL® Reagent (Invitrogen, Carlsbad, Calif.) according to the manufacturer's recommended protocols.

Analysis of Inhibition of Target Levels or Expression

Inhibition of levels or expression of an ANGPTL3 nucleic acid can be assayed in a variety of ways known in the art (Sambrook and Russell, Molecular Cloning: A Laboratory Manual, $3^{rd}$ Ed., 2001). For example, target nucleic acid levels can be quantitated by, e.g., Northern blot analysis, competitive polymerase chain reaction (PCR), or quantitative real-time PCR. RNA analysis can be performed on total cellular RNA or poly(A)+mRNA. Methods of RNA isolation are well known in the art. Northern blot analysis is also routine in the art. Quantitative real-time PCR can be conveniently accomplished using the commercially available ABI PRISM® 7600, 7700, or 7900 Sequence Detection System, available from PE-Applied Biosystems, Foster City, Calif. and used according to manufacturer's instructions.

Quantitative Real-Time PCR Analysis of Target RNA Levels

Quantitation of target RNA levels can be accomplished by quantitative real-time PCR using the ABI PRISM® 7600, 7700, or 7900 Sequence Detection System (PE-Applied Biosystems, Foster City, Calif.) according to manufacturer's instructions. Methods of quantitative real-time PCR are well known in the art.

Prior to real-time PCR, the isolated RNA is subjected to a reverse transcriptase (RT) reaction, which produces complementary DNA (cDNA) that is then used as the substrate for the real-time PCR amplification. The RT and real-time PCR reactions are performed sequentially in the same sample well. RT and real-time PCR reagents are obtained from Invitrogen (Carlsbad, Calif.). RT and real-time-PCR reactions are carried out by methods well known to those skilled in the art.

Gene (or RNA) target quantities obtained by real time PCR can be normalized using either the expression level of a gene whose expression is constant, such as cyclophilin A or GADPH or by quantifying total RNA using RIBOGREEN® (Life Technologies™, Inc. Carlsbad, Calif.). Cyclophilin A or GADPH expression can be quantified by real time PCR, by being run simultaneously with the target, multiplexing, or separately. Total RNA can be quantified using RIBOGREEN® RNA quantification reagent. Methods of RNA quantification by RIBOGREEN® are taught in Jones, L. J., et al, (Analytical Biochemistry, 1998, 265, 368-374). A CYTOFLUOR® 4000 instrument (PE Applied Biosystems) can be used to measure RIBOGREEN® fluorescence.

Methods for designing real-time PCR probes and primers are well known in the art, and can include the use of software such as PRIMER EXPRESS® Software (Applied Biosystems, Foster City, Calif.). Probes and primers used in real-time PCR were designed to hybridize to ANGPTL3 specific sequences and are disclosed in the Examples below. The target specific PCR probes can have FAM covalently linked to the 5' end and TAMRA or MGB covalently linked to the 3' end, where FAM is the fluorescent dye and TAMRA or MGB is the quencher dye.

Analysis of Protein Levels

Antisense inhibition of ANGPTL3 nucleic acids can be assessed by measuring ANGPTL3 protein levels. Protein levels of ANGPTL3 can be evaluated or quantitated in a variety of ways well known in the art, such as immunoprecipitation, Western blot analysis (immunoblotting), enzyme-linked immunosorbent assay (ELISA), quantitative protein assays, protein activity assays (for example, caspase activity assays), immunohistochemistry, immunocytochemistry or fluorescence-activated cell sorting (FACS) (Sambrook and Russell, Molecular Cloning: A Laboratory Manual, $3^{rd}$ Ed., 2001). Antibodies directed to a target can be identified and obtained from a variety of sources, such as the MSRS catalog of antibodies (Aerie Corporation, Birmingham, Mich.), or can be prepared via conventional monoclonal or polyclonal antibody generation methods well known in the art.

In Vivo Testing of Antisense Compounds

Antisense compounds, for example, antisense oligonucleotides, are tested in animals to assess their ability to inhibit expression of ANGPTL3 and produce phenotypic changes. Testing can be performed in normal animals, or in experimental disease models. For administration to animals, antisense oligonucleotides are formulated in a pharmaceutically acceptable diluent, such as phosphate-buffered saline. Administration includes parenteral routes of administration. Following a period of treatment with antisense oligonucleotides, RNA is isolated from tissue and changes in ANGPTL3 nucleic acid expression are measured. Changes in ANGPTL3 protein levels are also measured.

Certain Indications

In certain embodiments, provided herein are methods of treating an individual comprising administering one or more pharmaceutical compositions as described herein. In certain embodiments, the individual has a metabolic disease and/or cardiovascular disease. In certain embodiments, the individual has hypercholesterolemia (e.g., familial homozygous hypercholesterolemia (HoFH), familial heterozygous hypercholesterolemia (HeFH)), dyslipidemia, hypertriglyceridemia (e.g., heterozygous LPL deficiency, homozygous LPL deficiency), coronary artery disease (CAD), familial chylomicronemia syndrome (FCS), hyperlipoproteinemia Type IV), lipodystrophy, hyperlipidemia (e.g., combined hyperlipidemia, familial combined hyperlipidemia (FCHL)), metabolic syndrome, non-alcoholic fatty liver disease (NAFLD), nonalcoholic steatohepatitis (NASH), diabetes (e.g., Type 2 diabetes), vascular wall thickening, high blood pressure (e.g., pulmonary arterial hypertension), sclerosis (e.g., atherosclerosis, systemic sclerosis, progressive skin sclerosis and proliferative obliterative vasculopathy such as digital ulcers and pulmonary vascular involvement).

In certain embodiments, the compounds targeted to ANGPTL3 described herein modulate lipid and/or energy metabolism in an animal. In certain embodiments, the compounds targeted to ANGPTL3 described herein modulate physiological markers or phenotypes of hypercholesterolemia, dyslipidemia, hypertriglyceridemia, metabolic syndrome, NAFLD, NASH and/or diabetes. For example, administration of the compounds to animals can modulate one or more of VLDL, non-esterified fatty acids (NEFA), LDL, cholesterol, triglyceride, glucose, insulin or ANGPTL3 levels. In certain embodiments, the modulation of the physiological markers or phenotypes can be associated with inhibition of ANGPTL3 by the compounds.

In certain embodiments, the compounds targeted to ANGPTL3 described herein reduce and/or prevent one or more of hepatic TG accumulation (i.e. hepatic steatosis), atherosclerosis, vascular wall thickening (e.g., arterial intima-media thickening), hypercholesterolemia (e.g., familial homozygous hypercholesterolemia (HoFH), familial heterozygous hypercholesterolemia (HeFH)), dyslipidemia, hypertriglyceridemia (e.g., heterozygous LPL deficiency, homozygous LPL deficiency, familial chylomicronemia syndrome (FCS), hyperlipoproteinemia Type IV), lipodystrophy, hyperlipidemia (e.g., combined hyperlipidemia, familial combined hyperlipidemia (FCHL)), metabolic syndrome, non-alcoholic fatty liver disease (NAFLD), nonalcoholic steatohepatitis (NASH), diabetes (e.g., Type 2 diabetes), high blood pressure and sclerosis. In certain embodiments, the compounds targeted to ANGPTL3 described herein improve insulin sensitivity.

In certain embodiments, administration of an antisense compound targeted to an ANGPTL3 nucleic acid as described herein results in reduction of ANGPTL3 expression by about at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95% or at least 99%, or a range defined by any two of these values.

In certain embodiments, administration of an antisense compound targeted to an ANGPTL3 nucleic acid as described herein results in reduction of one or more of triglycerides, LDL-cholesterol, non-HDL cholesterol, VLDL-cholesterol, total cholesterol, ApoB and ApoC-III by about at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95% or at least 99%, or a range defined by any two of these values.

In certain embodiments, pharmaceutical compositions comprising an antisense compound targeted to ANGPTL3 are used for the preparation of a medicament for treating a patient suffering from, or susceptible to, a metabolic disease or cardiovascular disease. In certain embodiments, pharmaceutical compositions comprising an antisense compound targeted to ANGPTL3 are used in the preparation of a medicament for treating a patient suffering from, or susceptible to, one or more of hypercholesterolemia (e.g., familial homozygous hypercholesterolemia (HoFH), familial heterozygous hypercholesterolemia (HeFH)), dyslipidemia, hypertriglyceridemia (e.g., familial chylomicronemia syndrome (FCS), hyperlipoproteinemia Type IV), lipodystrophy, hyperlipidemia (e.g., combined hyperlipidemia, familial combined hyperlipidemia (FCHL)), metabolic syndrome, non-alcoholic fatty liver disease (NAFLD), nonalcoholic steatohepatitis (NASH), diabetes (e.g., Type 2 diabetes) vascular wall thickening, high blood pressure and sclerosis.

Administration

In certain embodiments, the compounds and compositions as described herein are administered parenterally.

In certain embodiments, parenteral administration is by infusion. Infusion can be chronic or continuous or short or intermittent. In certain embodiments, infused pharmaceutical agents are delivered with a pump.

In certain embodiments, parenteral administration is by injection. The injection can be delivered with a syringe or a pump. In certain embodiments, the injection is a bolus injection. In certain embodiments, the injection is administered directly to a tissue or organ. In certain embodiments, the injection is subcutaneous.

Certain Combination Therapies

In certain embodiments, a first agent comprising the modified oligonucleotide disclosed herein is co-administered with one or more secondary agents. In certain embodiments, such second agents are designed to treat the same disease, disorder or condition as the first agent described herein. In certain embodiments, such second agents are designed to treat a different disease, disorder, or condition as the first agent described herein. In certain embodiments, such second agents are designed to treat an undesired side effect of one or more pharmaceutical compositions as described herein. In certain embodiments, second agents are co-administered with the first agent to treat an undesired effect of the first agent. In certain embodiments, second agents are co-administered with the first agent to produce a combinational effect. In certain embodiments, second agents are co-administered with the first agent to produce a synergistic effect.

In certain embodiments, a first agent and one or more second agents are administered at the same time. In certain embodiments, the first agent and one or more second agents are administered at different times. In certain embodiments, the first agent and one or more second agents are prepared together in a single pharmaceutical formulation. In certain embodiments, the first agent and one or more second agents are prepared separately.

In certain embodiments, second agents include, but are not limited to a glucose-lowering agent or a lipid-lowering agent. The glucose lowering agent can include, but is not limited to, a therapeutic lifestyle change, PPAR agonist, a dipeptidyl peptidase (IV) inhibitor, a GLP-1 analog, insulin or an insulin analog, an insulin secretagogue, a SGLT2 inhibitor, a human amylin analog, a biguanide, an alpha-glucosidase inhibitor, or a combination thereof. The glucose-lowering agent can include, but is not limited to metformin, sulfonylurea, rosiglitazone, meglitinide, thiazolidinedione, alpha-glucosidase inhibitor or a combination thereof. The sulfonylurea can be acetohexamide, chlorpropamide, tolbutamide, tolazamide, glimepiride, a glipizide, a glyburide, or a gliclazide. The meglitinide can be nateglinide or repaglinide. The thiazolidinedione can be pioglitazone or rosiglitazone. The alpha-glucosidase can be acarbose or miglitol. In certain embodiments the lipid lowering therapy can include, but is not limited to, a therapeutic lifestyle change, niacin, HMG-CoA reductase inhibitor, cholesterol absorption inhibitor, MTP inhibitor (e.g., a small molecule, polypeptide, antibody or antisense compound targeted to MTP), fibrate, PCSK9 inhibitor (e.g., PCSK9 antibodies, polypeptides, small molecules nucleic acid compounds targeting PCSK9), CETP inhibitor (e.g., small molecules such as torcetrapib and anacetrapib, polypeptides, antibodies or nucleic acid compounds targeted to CETP), apoC-III inhibitor (e.g., a small molecule, polypeptide, antibody or nucleic acid compounds targeted to apoC-III), apoB inhibitor (e.g., a small molecule, polypeptide, antibody or nucleic acid compounds targeted to apoB), beneficial oils rich in omega-3 fatty acids, omega-3 fatty acids or any combination thereof. The HMG-CoA reductase inhibitor can be atorvastatin, rosuvastatin, fluvastatin, lovastatin, pravastatin, simvastatin and the like. The cholesterol absorption inhibitor can be ezetimibe. The fibrate can be fenofibrate, bezafibrate, ciprofibrate, clofibrate, gemfibrozil and the like. The beneficial oil rich in omega-3 fatty acids can be krill, fish (e.g., Vascepa®), flaxseed oil and the like. The omega-3 fatty acid can be ALA, DHA, EPA and the like.

Certain Compounds

Antisense oligonucleotides targeting human ANGPTL3 were described in an earlier publication (see PCT Patent Publication No. WO 2011/085271 published Jul. 14, 2011, incorporated by reference herein, in its entirety). Several oligonucleotides (233676, 233690, 233710, 233717, 233721, 233722, 337459, 337460, 337474, 337477, 337478, 337479, 337481, 337484, 337487, 337488, 337490, 337491, 337492, 337497, 337498, 337503, 337505, 337506, 337508, 337513, 337514, 337516, 337520, 337521, 337525, 337526 and 337528) described therein, including the top ten most potent antisense compounds in vitro, were used as benchmarks throughout select in vitro screens for new antisense compounds described hereinbelow. Of the most potent compounds described in WO 2011/085271, ISIS 233722 was found to be highly variable in its ability to inhibit ANGPTL3. According, although initially included in some in vitro studies, 233722 was not selected as a benchmark for further studies. Of the previously identified potent in vitro benchmark compounds, five (233710, 233717, 337477, 337478, 337479 and 337487) were selected for testing in vivo, as described hereinbelow, in huANGPTL3 transgenic mice to assess the most potent in reducing human mRNA transcript and protein expression (Example 11). The antisense oligonucleotide with the highest initial in vivo potency in reducing ANGPTL3 levels (233710) was used as a benchmark for in vivo assessment of the new antisense compounds described hereinbelow.

In certain embodiments, the antisense compounds described herein benefit from one or more improved properties relative to the antisense compounds described in WO 2011/085271. These improved properties are demonstrated in the examples herein, and a non-exhaustive summary of the examples is provided below for ease of reference.

In a first screen described herein, about 3000 newly designed 5-10-5 MOE gapmer antisense compounds targeting human ANGPTL3 were tested in Hep3B cells for their effect on human ANGPTL3 mRNA in vitro (Example 1). The mRNA inhibition levels of the new antisense compounds were assessed with some previously designed antisense compounds (233717, 337484, 337487, 337492 and 337516) used as benchmarks in select studies. Of the about 3000 newly designed antisense compounds from this first screen, about 85 antisense compounds were selected for in vitro dose-dependent inhibition studies to determine their half maximal inhibitory concentration ($IC_{50}$) (Examples 2-3). Of the about 85 new antisense compounds tested for their half maximal inhibitory concentration ($IC_{50}$), about 38 antisense compounds that demonstrated potent dose-dependent reduction of ANGPTL3 were selected for in vivo potency and tolerability (ALT and AST) testing in mice (Examples 11-12) with antisense compound 233710 used as a benchmark.

In a second screen described herein, about 2000 newly designed antisense compounds targeting human ANGPTL3 with a MOE gapmer motif or a mixed motif (deoxy, 5-10-5 MOE and cET gapmers) were also tested in Hep3B cells for their effect on human ANGPTL3 mRNA in vitro (Examples 4-6). The inhibition levels of the new antisense compounds were assessed with some previously designed antisense compounds (233717, 337487, 337513, 337514 and 337516) used as benchmarks in select studies. Of the about 2000 newly designed antisense compounds from this second screen, about 147 antisense compounds were selected for in vitro dose-dependent inhibition studies to determine their half maximal inhibitory concentration ($IC_{50}$) (Examples 7-10). Of the about 147 new antisense compounds from tested for their half maximal inhibitory concentration (IC$_{50}$), about 73 antisense compounds that demonstrated potent dose-dependent reduction of ANGPTL3 were selected for in vivo potency and tolerability (e.g., ALT and AST) testing in mice (Examples 11-12) with antisense compound 233710 used as a benchmark.

Of the about 111 antisense compounds from screens one and two that were tested for potency and tolerability in mice, 24 were selected for more extensive tolerability testing in mice by assessing liver metabolic markers, such as alanine transaminase (ALT), aspartate transaminase (AST), albumin and bilirubin, as well as kidney metabolic markers BUN and creatinine and organ weight (Example 12).

In parallel with the in vivo murine studies seventeen antisense compounds were selected for viscosity testing (Example 13). Generally, antisense compounds that were not optimal for viscosity were not taken forward in further studies.

Based on the results of the mice tolerability study, twenty antisense compounds were selected for in vivo tolerability testing in rats (Example 14). In the rats, liver metabolic markers, such as ALT, AST, albumin and bilirubin, body and organ weights, as well as kidney metabolic markers, such as BUN, creatinine and total protein/creatinine ratio, were measured to determine the tolerability of a compound in vivo.

The twenty antisense compounds tested in the rats were also assessed for cross-reactivity to a rhesus monkey ANGPTL3 gene sequence (Example 15). Although the antisense compounds in this study were tested in cynomolgus monkeys, the cynomolgus monkey ANGPTL3 sequence was not available for comparison to the sequences of the full-length compounds, therefore the sequences of the antisense compounds were compared to that of the closely related rhesus monkey. The sequences of eight antisense compounds were found to have 0-2 mismatches with the rhesus ANGPTL3 gene sequence and were further studied in cynomolgus monkeys (Example 15). The eight antisense compounds (ISIS 563580, ISIS 560400, ISIS 567320, ISIS 567321, ISIS 544199, ISIS 567233, ISIS 561011 and ISIS 559277) were tested for inhibition of ANGPTL3 mRNA and protein expression as well as tolerability in the monkeys. In the tolerability studies, body weights, liver metabolic markers (ALT, AST and bilirubin), kidney metabolic markers (BUN and creatinine), hematology parameters (blood cell counts, hemoglobin and hematocrit), and pro-inflammatory markers (CRP and C3) were measured. Additionally, the full-length oligonucleotide concentration present in liver and kidney was measured and the ratio of full-length oligonucleotide in the kidney/liver was calculated.

Accordingly, provided herein are antisense compounds with any one or more improved characteristics e.g., improved relative to the antisense compounds described in WO 2011/085271. In certain embodiments, provided herein are antisense compounds comprising a modified oligonucleotide as described herein targeted to, or specifically hybridizable with, a region of nucleotides of any one of SEQ ID NOs: 1-2.

In certain embodiments, certain antisense compounds as described herein are efficacious by virtue of their potency in inhibiting ANGPTL3 expression. In certain embodiments, the compounds or compositions inhibit ANGPTL3 by at least 40%, at least 45%, at least 50%, at least 55%, at least 60%, at least 65%, at least 70%, at least 75%, at least 80%, at least 85%, at least 90% or at least 95%.

In certain embodiments, certain antisense compounds as described herein are efficacious by virtue of an in vitro IC$_{50}$ of less than 20 µM, less than 10 µM, less than 8 µM, less than 5 µM, less than 2 µM, less than 1 µM, less than 0.9 µM, less than 0.8 µM, less than 0.7 µM, less than 0.6 µM, or less than 0.5 µM when tested in human cells, for example, in the Hep3B cell line (as described in Examples 2-3 and 7-10). In certain embodiments, preferred antisense compounds having an IC$_{50}$<1.0 µM include SEQ ID NOs: 15, 20, 24, 34, 35, 36, 37, 42, 43, 44, 47, 50, 51, 57, 58, 60, 77, 79, 82, 87, 88, 90, 91, 93, 94, 100, 101, 104, 110, 111, 112, 113, 114, 115, 116, 117, 118, 119, 120, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 169, 170, 177, 188, 209, 210, 211, 212, 213, 214, 215, 216, 217, 218, 219, 220, 221, 222, 223, 224, 225, 226, 227, 228, 229, 230, 231, and 232. In certain embodiments, preferred antisense compounds having an IC$_{50}$<0.9 µM include SEQ ID NOs: 15, 20, 35, 36, 42, 43, 44, 50, 57, 60, 77, 79, 87, 88, 90, 91, 93, 94, 101, 104, 110, 111, 112, 113, 114, 115, 116, 117, 118, 119, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 177, 209, 210, 211, 212, 213, 214, 215, 216, 217, 218, 219, 220, 221, 222, 223, 224, 225, 226, 227, 228, 229, 230, 231, and 232. In certain embodiments, preferred antisense compounds having an IC$_{50}$<0.8 µM include SEQ ID NOs: 15, 20, 35, 36, 42, 43, 44, 50, 57, 60, 77, 79, 87, 88, 90, 91, 93, 94, 101, 104, 110, 111, 112, 113, 114, 115, 116, 117, 118, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 177, 209, 210, 211, 212, 213, 214, 215, 217, 218, 219, 220, 221, 222, 223, 224, 225, 228, 229, 230, 231, and 232. In certain embodiments, preferred antisense compounds having an IC$_{50}$<0.7 µM include SEQ ID NOs: 15, 20, 36, 42, 43, 57, 60, 114, 117, 127, 131, 177, 209, 210, 211, 212, 213, 214, 215, 217, 218, 219, 220, 221, 222, 223, 224, 225, 228, 229, 230, 231, and 232. In certain embodiments, preferred antisense compounds having an IC$_{50}$<0.6 µM include SEQ ID NOs: 15, 20, 36, 42, 43, 57, 60, 114, 117, 127, 131, 177, 209, 210, 211, 212, 213, 215, 217, 218, 219, 220, 221, 222, 224, 225, 228, 229, 230, 231, and 232. In certain embodiments, preferred antisense compounds having an IC$_{50}$<0.5 µM include SEQ ID NOs: 43, 114, 117, 127, 131, 177, 209, 210, 211, 212, 215, 217, 218, 219, 220, 221, 222, 229, 230, and 232.

In certain embodiments, certain antisense compounds as described herein are efficacious by virtue of having a viscosity of less than 40 cP, less than 35 cP, less than 30 cP, less than 25 cP, less than 20 cP, less than 15 cP, or less than 10 cP when measured by an assay (as described in Example 13). Oligonucleotides having a viscosity greater than 40 cP would have less than optimal viscosity. In certain embodiments, preferred antisense compounds having a viscosity <20 cP include SEQ ID NOs: 16, 18, 20, 34, 35, 36, 38, 49, 77, 90, 93, and 94. In certain embodiments, preferred antisense compounds having a viscosity <15 cP include SEQ ID NOs: 16, 18, 20, 34, 35, 38, 49, 90, 93, and 94. In certain embodiments, preferred antisense compounds having a viscosity <10 cP include SEQ ID NOs: 18, 34, 35, 49, 90, 93, and 94.

In certain embodiments, certain antisense compounds as described herein are highly tolerable, as demonstrated by the in vivo tolerability measurements described in the examples. In certain embodiments, the certain antisense compounds as described herein are highly tolerable, as demonstrated by having an increase in ALT and/or AST value of no more than 3 fold, 2 fold or 1.5 fold over saline treated animals.

In certain embodiments, certain antisense compounds as described herein are efficacious by virtue of having one or more of an inhibition potency of greater than 50%, an in vitro $IC_{50}$ of less than 1 µM, a viscosity of less than 20 cP, and no more than a 3 fold increase in ALT and/or AST.

In certain embodiments, ISIS 563580 (SEQ ID NO: 77) is preferred. This compound was found to be a potent inhibitor in ANGPTL3 transgenic mice and the most tolerable antisense compound. It had an acceptable viscosity of about 16.83 cP and an $IC_{50}$ value of <0.8 µM in vitro. In mice it had no more than a 3 fold increase in ALT and/or AST levels over saline treated animals. Also, in monkeys, it was among the most tolerable and potent compounds in inhibiting ANGPTL3 and had the best ratio of full-length oligonucleotide concentration.

In certain embodiments, ISIS 544199 (SEQ ID NO: 20) is preferred. This compound was found to be a potent and tolerable antisense compound. It had an acceptable viscosity of 1.7 cP and an $IC_{50}$ value of <0.5 µM in vitro. In mice it had no more than a 3 fold increase in ALT and/or AST levels over saline treated animals. Also, in monkeys, it was among the most potent compounds in inhibiting ANGPTL3 and had a good ratio of full-length oligonucleotide concentration.

In certain embodiments, ISIS 559277 (SEQ ID NO: 110) is preferred. This compound was found to be a potent and tolerable antisense compound. It had an $IC_{50}$ value of <0.8 µM in vitro. In mice it had no more than a 3 fold increase in ALT and/or AST levels over saline treated animals. Also, in monkeys, it was among the most potent compounds in inhibiting ANGPTL3 and had a good ratio of full-length oligonucleotide concentration.

EXAMPLES

Non-Limiting Disclosure and Incorporation by Reference

While certain compounds, compositions, and methods described herein have been described with specificity in accordance with certain embodiments, the following examples serve only to illustrate the compounds described herein and are not intended to limit the same. Each of the references recited in the present application is incorporated herein by reference in its entirety.

Example 1: Antisense Inhibition of Human Angiopoietin-Like 3 in Hep3B Cells by MOE Gapmers Antisense oligonucleotides were designed targeting an Angiopoietin-like 3 (ANGPTL3) nucleic acid and were tested for their effects on ANGPTL3 mRNA in vitro. The antisense oligonucleotides were tested in a series of experiments that had similar culture conditions. The results for each experiment are presented in separate tables shown below. Cultured Hep3B cells at a density of 20,000 cells per well were transfected using electroporation with 4,500 nM antisense oligonucleotide. After a treatment period of approximately 24 hours, RNA was isolated from the cells and ANGPTL3 mRNA levels were measured by quantitative real-time PCR. Human primer probe set RTS3492_MGB (forward sequence CCGTGGAAGAC-CAATATAAACAATT, designated herein as SEQ ID NO: 4; AGTCCTTCTGAGCTGATTTTCTATTTCT; reverse sequence, designated herein as SEQ ID NO: 5; probe sequence AACCAACAGCATAGTCAAATA, designated herein as SEQ ID NO: 6) was used to measure mRNA levels. ANGPTL3 mRNA levels were adjusted according to total RNA content, as measured by RIBOGREEN®. Results are presented as percent inhibition of ANGPTL3, relative to untreated control cells.

The newly designed chimeric antisense oligonucleotides in the Tables below were designed as 5-10-5 MOE gapmers. The 5-10-5 MOE gapmers are 20 nucleosides in length, wherein the central gap segment comprises often 2'-deoxynucleosides and is flanked by wing segments on the 5' direction and the 3' direction comprising five nucleosides each. Each nucleoside in the 5' wing segment and each nucleoside in the 3' wing segment has a 2'-MOE modification. The internucleoside linkages throughout each gapmer are phosphorothioate (P=S) linkages. All cytosine residues throughout each gapmer are 5-methylcytosines. "Start site" indicates the 5'-most nucleoside to which the gapmer is targeted in the human gene sequence. "Stop site" indicates the 3'-most nucleoside to which the gapmer is targeted human gene sequence. Each gapmer listed in the Tables below is targeted to either the human ANGPTL3 mRNA, designated herein as SEQ ID NO: 1 (GENBANK Accession No. NM_014495.2) or the human ANGPTL3 genomic sequence, designated herein as SEQ ID NO: 2 (GENBANK Accession No. NT_032977.9 truncated from nucleotides 33032001 to 33046000). 'n/a' indicates that the antisense oligonucleotide does not target that particular gene sequence with 100% complementarity.

TABLE 1

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544059 | 23 | 42 | GATTTTCAATTTCAAGCAAC | 40 | 3127 | 3146 | 238 |
| 337459 | 49 | 68 | AGCTTAATTGTGAACATTTT | 47 | 3153 | 3172 | 239 |
| 544060 | 54 | 73 | GAAGGAGCTTAATTGTGAAC | 1 | 3158 | 3177 | 240 |
| 544061 | 63 | 82 | CAATAAAAGAAGGAGCTTA | 37 | 3167 | 3186 | 241 |
| 544062 | 66 | 85 | GAACAATAAAAGAAGGAGC | 38 | 3170 | 3189 | 242 |
| 544063 | 85 | 104 | CTGGAGGAAATAACTAGAGG | 30 | 3189 | 3208 | 243 |

TABLE 1-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 337460 | 88 | 107 | ATTCTGGAGGAAATAACTAG | 39 | 3192 | 3211 | 244 |
| 544064 | 112 | 131 | TCAAATGATGAATTGTCTTG | 36 | 3216 | 3235 | 245 |
| 544065 | 138 | 157 | TTGATTTTGGCTCTGGAGAT | 26 | 3242 | 3261 | 246 |
| 544066 | 145 | 164 | GCAAATCTTGATTTTGGCTC | 56 | 3249 | 3268 | 247 |
| 233676 | 148 | 167 | ATAGCAAATCTTGATTTTGG | 69 | 3252 | 3271 | 248 |
| 544067 | 156 | 175 | CGTCTAACATAGCAAATCTT | 64 | 3260 | 3279 | 249 |
| 544068 | 174 | 193 | TGGCTAAAATTTTTACATCG | 28 | 3278 | 3297 | 250 |
| 544069 | 178 | 197 | CCATTGGCTAAAATTTTTAC | 0 | 3282 | 3301 | 251 |
| 544070 | 184 | 203 | AGGAGGCCATTGGCTAAAAT | 7 | 3288 | 3307 | 252 |
| 544071 | 187 | 206 | TGAAGGAGGCCATTGGCTAA | 32 | 3291 | 3310 | 253 |
| 544072 | 195 | 214 | GTCCCAACTGAAGGAGGCCA | 9 | 3299 | 3318 | 254 |
| 544073 | 199 | 218 | CCATGTCCCAACTGAAGGAG | 6 | 3303 | 3322 | 255 |
| 544074 | 202 | 221 | AGACCATGTCCCAACTGAAG | 18 | 3306 | 3325 | 256 |
| 544075 | 206 | 225 | TTTAAGACCATGTCCCAACT | 0 | 3310 | 3329 | 257 |
| 544076 | 209 | 228 | GTCTTTAAGACCATGTCCCA | 0 | 3313 | 3332 | 258 |
| 544077 | 216 | 235 | GGACAAAGTCTTTAAGACCA | 0 | 3320 | 3339 | 259 |
| 544078 | 222 | 241 | TCTTATGGACAAAGTCTTTA | 0 | 3326 | 3345 | 260 |
| 544079 | 245 | 264 | TATGTCATTAATTTGGCCCT | 0 | 3349 | 3368 | 261 |
| 544080 | 270 | 289 | GATCAAATATGTTGAGTTTT | 27 | 3374 | 3393 | 262 |
| 233690 | 274 | 293 | GACTGATCAAATATGTTGAG | 49 | 3378 | 3397 | 263 |
| 544081 | 316 | 335 | TCTTCTTTGATTTCACTGGT | 62 | 3420 | 3439 | 264 |
| 544082 | 334 | 353 | CTTCTCAGTTCCTTTTCTTC | 35 | 3438 | 3457 | 265 |
| 544083 | 337 | 356 | GTTCTTCTCAGTTCCTTTTC | 60 | 3441 | 3460 | 266 |
| 544084 | 341 | 360 | TGTAGTTCTTCTCAGTTCCT | 51 | 3445 | 3464 | 267 |
| 544431 | 345 | 364 | TATATGTAGTTCTTCTCAGT | 9 | 3449 | 3468 | 268 |
| 544086 | 348 | 367 | GTTTATATGTAGTTCTTCTC | 39 | 3452 | 3471 | 269 |
| 544087 | 352 | 371 | TGTAGTTTATATGTAGTTCT | 30 | 3456 | 3475 | 270 |
| 544088 | 356 | 375 | GACTTGTAGTTTATATGTAG | 12 | 3460 | 3479 | 271 |
| 544089 | 364 | 383 | TCATTTTGACTTGTAGTTT | 31 | 3468 | 3487 | 272 |
| 544090 | 369 | 388 | CCTCTTCATTTTGACTTGT | 61 | 3473 | 3492 | 273 |
| 544091 | 375 | 394 | TCTTTACCTCTTCATTTTG | 48 | 3479 | 3498 | 274 |
| 544092 | 380 | 399 | CATATTCTTTACCTCTTCAT | 35 | 3484 | 3503 | 275 |
| 544093 | 384 | 403 | GTGACATATTCTTTACCTCT | 63 | 3488 | 3507 | 276 |
| 544094 | 392 | 411 | GAGTTCAAGTGACATATTCT | 53 | 3496 | 3515 | 277 |
| 544095 | 398 | 417 | TGAGTTGAGTTCAAGTGACA | 31 | 3502 | 3521 | 278 |

TABLE 1-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544096 | 403 | 422 | AGTTTTGAGTTGAGTTCAAG | 14 | 3507 | 3526 | 279 |
| 544097 | 406 | 425 | TCAAGTTTTGAGTTGAGTTC | 38 | 3510 | 3529 | 280 |
| 544098 | 414 | 433 | GGAGGCTTTCAAGTTTTGAG | 39 | 3518 | 3537 | 281 |
| 544099 | 423 | 442 | TTTCTTCTAGGAGGCTTTCA | 57 | 3527 | 3546 | 282 |
| 544100 | 427 | 446 | ATTTTTTCTTCTAGGAGGCT | 39 | 3531 | 3550 | 283 |
| 544101 | 432 | 451 | GTAGAATTTTTCTTCTAGG | 28 | 3536 | 3555 | 284 |
| 544102 | 462 | 481 | GCTCTTCTAAATATTTCACT | 60 | 3566 | 3585 | 285 |
| 544103 | 474 | 493 | AGTTAGTTAGTTGCTCTTCT | 40 | 3578 | 3597 | 286 |
| 544104 | 492 | 511 | CAGGTTGATTTTGAATTAAG | 38 | 3596 | 3615 | 287 |
| 544105 | 495 | 514 | TTTCAGGTTGATTTTGAATT | 28 | 3599 | 3618 | 288 |
| 544106 | 499 | 518 | GGAGTTTCAGGTTGATTTTG | 38 | 3603 | 3622 | 289 |
| 544107 | 504 | 523 | GTTCTGGAGTTTCAGGTTGA | 50 | 3608 | 3627 | 290 |
| 544108 | 526 | 545 | TTAAGTGAAGTTACTTCTGG | 20 | 3630 | 3649 | 291 |
| 544109 | 555 | 574 | TGCTATTATCTTGTTTTTCT | 23 | 4293 | 4312 | 292 |
| 544110 | 564 | 583 | GGTCTTTGATGCTATTATCT | 67 | 4302 | 4321 | 293 |
| 544111 | 567 | 586 | GAAGGTCTTTGATGCTATTA | 49 | 4305 | 4324 | 294 |
| 544112 | 572 | 591 | CTGGAGAAGGTCTTTGATGC | 52 | 4310 | 4329 | 295 |
| 544113 | 643 | 662 | CTGAGCTGATTTTCTATTTC | 12 | n/a | n/a | 296 |
| 337477 | 664 | 683 | GGTTCTTGAATACTAGTCCT | 70 | 6677 | 6696 | 234 |
| 544114 | 673 | 692 | ATTTCTGTGGGTTCTTGAAT | 32 | 6686 | 6705 | 297 |
| 337478 | 675 | 694 | AAATTTCTGTGGGTTCTTGA | 51 | 6688 | 6707 | 235 |
| 544115 | 678 | 697 | GAGAAATTTCTGTGGGTTCT | 54 | 6691 | 6710 | 298 |
| 544116 | 682 | 701 | GATAGAGAAATTTCTGTGGG | 25 | 6695 | 6714 | 299 |
| 544117 | 689 | 708 | CTTGGAAGATAGAGAAATTT | 16 | 6702 | 6721 | 300 |
| 337479 | 692 | 711 | TGGCTTGGAAGATAGAGAAA | 34 | 6705 | 6724 | 236 |
| 544118 | 699 | 718 | GTGCTCTTGGCTTGGAAGAT | 64 | 6712 | 6731 | 301 |
| 544119 | 703 | 722 | CTTGGTGCTCTTGGCTTGGA | 70 | 6716 | 6735 | 302 |
| 544120 | 707 | 726 | AGTTCTTGGTGCTCTTGGCT | 82 | 6720 | 6739 | 15 |
| 233710 | 710 | 729 | AGTAGTTCTTGGTGCTCTTG | 63 | 6723 | 6742 | 233 |
| 544121 | 713 | 732 | GGGAGTAGTTCTTGGTGCTC | 64 | 6726 | 6745 | 303 |
| 544122 | 722 | 741 | CTGAAGAAAGGGAGTAGTTC | 24 | 6735 | 6754 | 304 |
| 544123 | 752 | 771 | ATCATGTTTTACATTTCTTA | 0 | 6765 | 6784 | 305 |
| 544124 | 755 | 774 | GCCATCATGTTTTACATTTC | 35 | n/a | n/a | 306 |
| 544125 | 759 | 778 | GAATGCCATCATGTTTTACA | 8 | n/a | n/a | 307 |

TABLE 1-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544126 | 762 | 781 | CAGGAATGCCATCATGTTTT | 6 | n/a | n/a | 308 |
| 337487 | 804 | 823 | CACTTGTATGTTCACCTCTG | 65 | 7389 | 7408 | 28 |
| 233717 | 889 | 908 | TGAATTAATGTCCATGGACT | 33 | 7876 | 7895 | 14 |

TABLE 2

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544204 | n/a | n/a | GACTTCTTAACTCTATATAT | 0 | 3076 | 3095 | 309 |
| 544205 | n/a | n/a | CTAGACTTCTTAACTCTATA | 0 | 3079 | 3098 | 310 |
| 544206 | n/a | n/a | GACCTAGACTTCTTAACTCT | 0 | 3082 | 3101 | 311 |
| 544207 | n/a | n/a | GGAAGCAGACCTAGACTTCT | 21 | 3089 | 3108 | 312 |
| 544208 | n/a | n/a | TCTGGAAGCAGACCTAGACT | 23 | 3092 | 3111 | 313 |
| 544209 | n/a | n/a | TCTTCTGGAAGCAGACCTAG | 7 | 3095 | 3114 | 314 |
| 544210 | n/a | n/a | CTAATCTTTAGGGATTTAGG | 24 | 11433 | 11452 | 315 |
| 544211 | n/a | n/a | TGTATCTAATCTTTAGGGAT | 2 | 11438 | 11457 | 316 |
| 544213 | n/a | n/a | TAACTTGGGCACTATATCCT | 44 | 11553 | 11572 | 317 |
| 544214 | n/a | n/a | ATTGACAAAGGTAGGTCACC | 59 | 11576 | 11595 | 318 |
| 544215 | n/a | n/a | ATATGACATGTATATTGGAT | 41 | 11620 | 11639 | 319 |
| 544216 | n/a | n/a | TTTTGTACTTTTCTGGAACA | 34 | 11704 | 11723 | 320 |
| 544217 | n/a | n/a | TAGTCTGTGGTCCTGAAAAT | 32 | 11748 | 11767 | 321 |
| 544218 | n/a | n/a | AGCTTAGTCTGTGGTCCTGA | 20 | 11752 | 11771 | 322 |
| 544219 | n/a | n/a | GACAGCTTAGTCTGTGGTCC | 45 | 11755 | 11774 | 323 |
| 544220 | n/a | n/a | GTATTCTGGCCCTAAAAAAA | 2 | 11789 | 11808 | 324 |
| 544221 | n/a | n/a | ATTTTGGTATTCTGGCCCTA | 39 | 11795 | 11814 | 325 |
| 544223 | n/a | n/a | TTTGCATTTGAAATTGTCCA | 32 | 11837 | 11856 | 326 |
| 544224 | n/a | n/a | GGAAGCAACTCATATATTAA | 39 | 11869 | 11888 | 327 |
| 544225 | n/a | n/a | TATCAGAAAAGATACCTGA | 0 | 9821 | 9840 | 328 |
| 544226 | n/a | n/a | ATAATAGCTAATAATGTGGG | 15 | 9875 | 9894 | 329 |
| 544227 | n/a | n/a | TGCAGATAATAGCTAATAAT | 31 | 9880 | 9899 | 330 |
| 544228 | n/a | n/a | TGTCATTGCAGATAATAGCT | 61 | 9886 | 9905 | 331 |
| 544229 | n/a | n/a | TAAAAGTTGTCATTGCAGAT | 38 | 9893 | 9912 | 332 |
| 544230 | n/a | n/a | CGGATTTTTAAAAGTTGTCA | 45 | 9901 | 9920 | 333 |

TABLE 2-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544231 | n/a | n/a | GGGATTCGGATTTTTAAAAG | 0 | 9907 | 9926 | 334 |
| 544232 | n/a | n/a | TTTGGGATTCGGATTTTTAA | 24 | 9910 | 9929 | 335 |
| 544233 | n/a | n/a | ACGCTTATTTGGGATTCGGA | 53 | 9917 | 9936 | 336 |
| 544251 | n/a | n/a | TTTAAGAGATTTACAAGTCA | 11 | 2811 | 2830 | 337 |
| 544252 | n/a | n/a | GACTACCTGTTTTTAAAAGC | 6 | 2851 | 2870 | 338 |
| 544253 | n/a | n/a | TATGGTGACTACCTGTTTTT | 12 | 2857 | 2876 | 339 |
| 544254 | n/a | n/a | ACTTTGCTGTATTATAAACT | 12 | 2890 | 2909 | 340 |
| 544255 | n/a | n/a | ATTGTATTTAACTTTGCTGT | 0 | 2900 | 2919 | 341 |
| 544256 | n/a | n/a | GAGCAACTAACTTAATAGGT | 13 | 2928 | 2947 | 342 |
| 544257 | n/a | n/a | GAAATGAGCAACTAACTTAA | 25 | 2933 | 2952 | 343 |
| 544258 | n/a | n/a | AATCAAAGAAATGAGCAACT | 0 | 2940 | 2959 | 344 |
| 544259 | n/a | n/a | ACCTTCTTCCACATTGAGTT | 8 | 2977 | 2996 | 345 |
| 544260 | n/a | n/a | CACGAATGTAACCTTCTTCC | 0 | 2987 | 3006 | 346 |
| 544261 | n/a | n/a | TTAACTTGCACGAATGTAAC | 27 | 2995 | 3014 | 347 |
| 544262 | n/a | n/a | TATATATACCAATATTTGCC | 0 | 3063 | 3082 | 348 |
| 544263 | n/a | n/a | TCTTAACTCTATATATACCA | 0 | 3072 | 3091 | 349 |
| 544264 | n/a | n/a | CTTTAAGTGAAGTTACTTCT | 17 | 3632 | 3651 | 350 |
| 544265 | n/a | n/a | TCTACTTACTTTAAGTGAAG | 9 | 3640 | 3659 | 351 |
| 544266 | n/a | n/a | GAACCCTCTTTATTTTCTAC | 1 | 3655 | 3674 | 352 |
| 544267 | n/a | n/a | ACATAAACATGAACCCTCTT | 6 | 3665 | 3684 | 353 |
| 544268 | n/a | n/a | CCACATTGAAAACATAAACA | 25 | 3676 | 3695 | 354 |
| 544269 | n/a | n/a | GCATGCCTTAGAAATATTTT | 7 | 3707 | 3726 | 355 |
| 544270 | n/a | n/a | CAATGCAACAAAGTATTTCA | 0 | 3731 | 3750 | 356 |
| 544271 | n/a | n/a | CTGGAGATTATTTTCTTGG | 34 | 3768 | 3787 | 357 |
| 544272 | n/a | n/a | TTCATATATAACATTAGGGA | 0 | 3830 | 3849 | 358 |
| 544273 | n/a | n/a | TCAGTGTTTTCATATATAAC | 18 | 3838 | 3857 | 359 |
| 544274 | n/a | n/a | GACATAGTGTTCTAGATTGT | 14 | 3900 | 3919 | 360 |
| 544275 | n/a | n/a | CAATAGTGTAATGACATAGT | 21 | 3912 | 3931 | 361 |
| 544276 | n/a | n/a | TTACTTACCTTCAGTAATTT | 0 | 3933 | 3952 | 362 |
| 544277 | n/a | n/a | ATCTTTTCCATTTACTGTAT | 8 | 4005 | 4024 | 363 |
| 544278 | n/a | n/a | AGAAAAAGCCCAGCATATTT | 11 | 4037 | 4056 | 364 |
| 544279 | n/a | n/a | GTATGCTTCTTTCAAATAGC | 36 | 4130 | 4149 | 365 |
| 544280 | n/a | n/a | CCTTCCCCTTGTATGCTTCT | 41 | 4140 | 4159 | 366 |
| 544281 | n/a | n/a | CCTGTAACACTATCATAATC | 1 | 4207 | 4226 | 367 |
| 544282 | n/a | n/a | TGACTTACCTGATTTTCTAT | 6 | 4384 | 4403 | 368 |
| 544283 | n/a | n/a | GATGGGACATACCATTAAAA | 0 | 4407 | 4426 | 369 |

TABLE 2-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544284 | n/a | n/a | GTGAAAGATGGGACATACCA | 20 | 4413 | 4432 | 370 |
| 544285 | n/a | n/a | CCTGTGTGAAAGATGGGACA | 6 | 4418 | 4437 | 371 |
| 544286 | n/a | n/a | CATTGGCTGCTATGAATTAA | 41 | 4681 | 4700 | 372 |
| 544287 | n/a | n/a | GATGACATTGGCTGCTATGA | 40 | 4686 | 4705 | 373 |
| 544288 | n/a | n/a | GAGAAACATGATCTAATTTG | 12 | 4717 | 4736 | 374 |
| 544289 | n/a | n/a | ATGGAAAGCTATTGTGTGGT | 0 | 4747 | 4766 | 375 |
| 544290 | n/a | n/a | GTCTAAAGAGCCAATATGAG | 22 | 4771 | 4790 | 376 |
| 544291 | n/a | n/a | AATCTTGGTCTAAAGAGCCA | 46 | 4778 | 4797 | 377 |
| 544433 | n/a | n/a | GAGATTTACAAGTCAAAAAT | 4 | 2806 | 2825 | 378 |
| 544434 | n/a | n/a | ATTTAACTTTGCTGTATTAT | 0 | 2895 | 2914 | 379 |
| 544435 | n/a | n/a | ATCAATGCTAAATGAAATCA | 0 | 2955 | 2974 | 380 |
| 544436 | n/a | n/a | TATTTTCTGGAGATTATTTT | 0 | 3774 | 3793 | 381 |
| 544437 | n/a | n/a | AAAATGAATATTGGCAATTC | 0 | 4159 | 4178 | 382 |
| 233717 | 889 | 908 | TGAATTAATGTCCATGGACT | 36 | 7876 | 7895 | 14 |
| 544202 | 2081 | 2100 | AAAGTCAATGTGACTTAGTA | 42 | 11053 | 11072 | 383 |
| 544203 | 2104 | 2123 | AAGGTATAGTGATACCTCAT | 56 | 11076 | 11095 | 384 |

TABLE 3

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544127 | 765 | 784 | CAGCAGGAATGCCATCATGT | 4 | N/A | N/A | 385 |
| 544128 | 819 | 838 | TGATGGCATACATGCCACTT | 0 | 7404 | 7423 | 386 |
| 544129 | 828 | 847 | TGCTGGGTCTGATGGCATAC | 44 | 7413 | 7432 | 387 |
| 544130 | 832 | 851 | GAGTTGCTGGGTCTGATGGC | 16 | 7417 | 7436 | 388 |
| 544131 | 841 | 860 | AAAACTTGAGAGTTGCTGGG | 0 | 7426 | 7445 | 389 |
| 544132 | 848 | 867 | GACATGAAAACTTGAGAGT | 0 | 7433 | 7452 | 390 |
| 544133 | 859 | 878 | ACATCACAGTAGACATGAAA | 25 | 7444 | 7463 | 391 |
| 233717 | 889 | 908 | TGAATTAATGTCCATGGACT | 36 | 7876 | 7895 | 14 |
| 544134 | 915 | 934 | AGTTTTGTGATCCATCTATT | 46 | 7902 | 7921 | 392 |
| 544135 | 918 | 937 | TGAAGTTTTGTGATCCATCT | 42 | 7905 | 7924 | 393 |
| 544136 | 926 | 945 | CGTTTCATTGAAGTTTTGTG | 45 | 7913 | 7932 | 394 |
| 544137 | 946 | 965 | CCATATTTGTAGTTCTCCCA | 44 | 7933 | 7952 | 395 |
| 544138 | 949 | 968 | AAACCATATTTGTAGTTCTC | 25 | 7936 | 7955 | 396 |

TABLE 3-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544139 | 970 | 989 | AATTCTCCATCAAGCCTCCC | 35 | N/A | N/A | 397 |
| 233722 | 991 | 1010 | ATCTTCTCTAGGCCCAACCA | 65 | 9566 | 9585 | 398 |
| 544432 | 997 | 1016 | GAGTATATCTTCTCTAGGCC | 0 | 9572 | 9591 | 399 |
| 544140 | 1002 | 1021 | CTATGGAGTATATCTTCTCT | 6 | 9577 | 9596 | 400 |
| 544141 | 1008 | 1027 | GCTTCACTATGGAGTATATC | 63 | 9583 | 9602 | 401 |
| 544142 | 1013 | 1032 | AGATTGCTTCACTATGGAGT | 52 | 9588 | 9607 | 402 |
| 544143 | 1046 | 1065 | CCAGTCTTCCAACTCAATTC | 35 | 9621 | 9640 | 403 |
| 544144 | 1052 | 1071 | GTCTTTCCAGTCTTCCAACT | 64 | 9627 | 9646 | 404 |
| 544145 | 1055 | 1074 | GTTGTCTTTCCAGTCTTCCA | 80 | 9630 | 9649 | 16 |
| 544146 | 1059 | 1078 | GTTTGTTGTCTTTCCAGTCT | 59 | 9634 | 9653 | 405 |
| 544147 | 1062 | 1081 | AATGTTTGTTGTCTTTCCAG | 12 | 9637 | 9656 | 406 |
| 544148 | 1095 | 1114 | CGTGATTTCCCAAGTAAAAA | 56 | 9670 | 9689 | 407 |
| 544149 | 1160 | 1179 | GTTTTCCGGGATTGCATTGG | 33 | 9735 | 9754 | 408 |
| 544150 | 1165 | 1184 | TCTTTGTTTTCCGGGATTGC | 54 | 9740 | 9759 | 409 |
| 544151 | 1170 | 1189 | CCAAATCTTTGTTTTCCGGG | 64 | 9745 | 9764 | 410 |
| 544152 | 1173 | 1192 | ACACCAAATCTTTGTTTTCC | 37 | 9748 | 9767 | 411 |
| 544153 | 1178 | 1197 | AGAAAACACCAAATCTTTGT | 32 | 9753 | 9772 | 412 |
| 544154 | 1183 | 1202 | CAAGTAGAAAACACCAAATC | 13 | 9758 | 9777 | 413 |
| 544155 | 1188 | 1207 | GATCCCAAGTAGAAAACACC | 0 | 9763 | 9782 | 414 |
| 544156 | 1195 | 1214 | GCTTTGTGATCCCAAGTAGA | 74 | 9770 | 9789 | 17 |
| 544157 | 1198 | 1217 | TTTGCTTTGTGATCCCAAGT | 73 | 9773 | 9792 | 415 |
| 544158 | 1202 | 1221 | TCCTTTTGCTTTGTGATCCC | 62 | 9777 | 9796 | 416 |
| 544159 | 1208 | 1227 | GAAGTGTCCTTTTGCTTTGT | 30 | 9783 | 9802 | 417 |
| 544160 | 1246 | 1265 | TGCCACCACCAGCCTCCTGA | 60 | N/A | N/A | 418 |
| 544161 | 1253 | 1272 | CTCATCATGCCACCACCAGC | 73 | 10225 | 10244 | 419 |
| 544162 | 1269 | 1288 | GGTTGTTTTCTCCACACTCA | 76 | 10241 | 10260 | 18 |
| 544163 | 1276 | 1295 | CCATTTAGGTTGTTTTCTCC | 25 | 10248 | 10267 | 420 |
| 544164 | 1283 | 1302 | ATATTTACCATTTAGGTTGT | 25 | 10255 | 10274 | 421 |
| 544165 | 1294 | 1313 | CTTGGTTTGTTATATTTACC | 63 | 10266 | 10285 | 422 |
| 544166 | 1353 | 1372 | ACCTTCCATTTTGAGACTTC | 75 | 10325 | 10344 | 19 |
| 544167 | 1363 | 1382 | ATAGAGTATAACCTTCCATT | 71 | 10335 | 10354 | 423 |
| 544168 | 1367 | 1386 | TTTTATAGAGTATAACCTTC | 37 | 10339 | 10358 | 424 |
| 544169 | 1374 | 1393 | TGGTTGATTTTATAGAGTAT | 37 | 10346 | 10365 | 425 |
| 544170 | 1378 | 1397 | ATTTGGTTGATTTTATAGA | 3 | 10350 | 10369 | 426 |
| 544171 | 1383 | 1402 | TCAACATTTGGTTGATTTT | 16 | 10355 | 10374 | 427 |
| 544172 | 1390 | 1409 | GGATGGATCAACATTTTGGT | 51 | 10362 | 10381 | 428 |

TABLE 3-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544173 | 1393 | 1412 | GTTGGATGGATCAACATTTT | 62 | 10365 | 10384 | 429 |
| 544174 | 1396 | 1415 | TCTGTTGGATGGATCAACAT | 5 | 10368 | 10387 | 430 |
| 544175 | 1401 | 1420 | CTGAATCTGTTGGATGGATC | 55 | 10373 | 10392 | 431 |
| 544176 | 1407 | 1426 | AGCTTTCTGAATCTGTTGGA | 65 | 10379 | 10398 | 432 |
| 544177 | 1414 | 1433 | CATTCAAAGCTTTCTGAATC | 21 | 10386 | 10405 | 433 |
| 544178 | 1417 | 1436 | GTTCATTCAAAGCTTTCTGA | 66 | 10389 | 10408 | 434 |
| 544179 | 1420 | 1439 | TCAGTTCATTCAAAGCTTTC | 6 | 10392 | 10411 | 435 |
| 544180 | 1423 | 1442 | GCCTCAGTTCATTCAAAGCT | 68 | 10395 | 10414 | 436 |
| 544181 | 1427 | 1446 | ATTTGCCTCAGTTCATTCAA | 53 | 10399 | 10418 | 437 |
| 544182 | 1431 | 1450 | TTAAATTTGCCTCAGTTCAT | 40 | 10403 | 10422 | 438 |
| 544183 | 1436 | 1455 | GCCTTTTAAATTTGCCTCAG | 70 | 10408 | 10427 | 439 |
| 544184 | 1498 | 1517 | AGGATTTAATACCAGATTAT | 38 | 10470 | 10489 | 440 |
| 544185 | 1502 | 1521 | CTTAAGGATTTAATACCAGA | 56 | 10474 | 10493 | 441 |
| 544186 | 1505 | 1524 | TCTCTTAAGGATTTAATACC | 33 | 10477 | 10496 | 442 |
| 544187 | 1546 | 1565 | GACAGTGACTTTAAGATAAA | 35 | 10518 | 10537 | 443 |
| 544188 | 1572 | 1591 | TGTGATTGTATGTTTAATCT | 48 | 10544 | 10563 | 444 |
| 544189 | 1578 | 1597 | AGGTTATGTGATTGTATGTT | 48 | 10550 | 10569 | 445 |
| 544190 | 1583 | 1602 | CTTTAAGGTTATGTGATTGT | 48 | 10555 | 10574 | 446 |
| 544191 | 1589 | 1608 | GGTATTCTTTAAGGTTATGT | 62 | 10561 | 10580 | 447 |
| 544192 | 1656 | 1675 | ATTGATTCCCACATCACAAA | 47 | 10628 | 10647 | 448 |
| 544193 | 1661 | 1680 | CTAAAATTGATTCCCACATC | 67 | 10633 | 10652 | 449 |
| 544194 | 1665 | 1684 | CCATCTAAAATTGATTCCCA | 63 | 10637 | 10656 | 450 |
| 544195 | 1771 | 1790 | TTGTGATATTAGCTCATATG | 59 | 10743 | 10762 | 451 |
| 544196 | 1794 | 1813 | ACTAGTTTTTAAACTGGGA | 28 | 10766 | 10785 | 452 |
| 544197 | 1820 | 1839 | GTCAAGTTTAGAGTTTTAAC | 44 | 10792 | 10811 | 453 |
| 544198 | 1826 | 1845 | TATTTAGTCAAGTTTAGAGT | 14 | 10798 | 10817 | 454 |
| 544199 | 1907 | 1926 | TACACATACTCTGTGCTGAC | 82 | 10879 | 10898 | 20 |
| 544200 | 1913 | 1932 | GATTTTACACATACTCTGT | 57 | 10885 | 10904 | 455 |
| 544201 | 2008 | 2027 | CTGCTTCATTAGGTTTCATA | 61 | 10980 | 10999 | 456 |

TABLE 4

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544127 | 765 | 784 | CAGCAGGAATGCCATCATGT | 0 | N/A | N/A | 457 |
| 544128 | 819 | 838 | TGATGGCATACATGCCACTT | 13 | 7404 | 7423 | 458 |
| 544129 | 828 | 847 | TGCTGGGTCTGATGGCATAC | 49 | 7413 | 7432 | 459 |
| 544130 | 832 | 851 | GAGTTGCTGGGTCTGATGGC | 27 | 7417 | 7436 | 460 |
| 544131 | 841 | 860 | AAAACTTGAGAGTTGCTGGG | 0 | 7426 | 7445 | 461 |
| 544132 | 848 | 867 | GACATGAAAACTTGAGAGT | 0 | 7433 | 7452 | 462 |
| 544133 | 859 | 878 | ACATCACAGTAGACATGAAA | 18 | 7444 | 7463 | 463 |
| 233717 | 889 | 908 | TGAATTAATGTCCATGGACT | 55 | 7876 | 7895 | 14 |
| 544134 | 915 | 934 | AGTTTTGTGATCCATCTATT | 68 | 7902 | 7921 | 464 |
| 544135 | 918 | 937 | TGAAGTTTTGTGATCCATCT | 77 | 7905 | 7924 | 465 |
| 544136 | 926 | 945 | CGTTTCATTGAAGTTTTGTG | 60 | 7913 | 7932 | 466 |
| 544137 | 946 | 965 | CCATATTTGTAGTTCTCCCA | 64 | 7933 | 7952 | 467 |
| 544138 | 949 | 968 | AAACCATATTTGTAGTTCTC | 45 | 7936 | 7955 | 468 |
| 544139 | 970 | 989 | AATTCTCCATCAAGCCTCCC | 70 | N/A | N/A | 469 |
| 233722 | 991 | 1010 | ATCTTCTCTAGGCCCAACCA | 96 | 9566 | 9585 | 470 |
| 544432 | 997 | 1016 | GAGTATATCTTCTCTAGGCC | 69 | 9572 | 9591 | 471 |
| 544140 | 1002 | 1021 | CTATGGAGTATATCTTCTCT | 37 | 9577 | 9596 | 472 |
| 544141 | 1008 | 1027 | GCTTCACTATGGAGTATATC | 65 | 9583 | 9602 | 473 |
| 544142 | 1013 | 1032 | AGATTGCTTCACTATGGAGT | 55 | 9588 | 9607 | 474 |
| 544143 | 1046 | 1065 | CCAGTCTTCCAACTCAATTC | 31 | 9621 | 9640 | 475 |
| 544144 | 1052 | 1071 | GTCTTTCCAGTCTTCCAACT | 72 | 9627 | 9646 | 476 |
| 544145 | 1055 | 1074 | GTTGTCTTTCCAGTCTTCCA | 86 | 9630 | 9649 | 16 |
| 544146 | 1059 | 1078 | GTTTGTTGTCTTTCCAGTCT | 66 | 9634 | 9653 | 477 |
| 544147 | 1062 | 1081 | AATGTTTGTTGTCTTTCCAG | 21 | 9637 | 9656 | 478 |
| 544148 | 1095 | 1114 | CGTGATTTCCCAAGTAAAAA | 63 | 9670 | 9689 | 479 |
| 544149 | 1160 | 1179 | GTTTTCCGGGATTGCATTGG | 32 | 9735 | 9754 | 480 |
| 544150 | 1165 | 1184 | TCTTTGTTTTCCGGGATTGC | 48 | 9740 | 9759 | 481 |
| 544151 | 1170 | 1189 | CCAAATCTTTGTTTTCCGGG | 72 | 9745 | 9764 | 482 |
| 544152 | 1173 | 1192 | ACACCAAATCTTTGTTTTCC | 39 | 9748 | 9767 | 483 |
| 544153 | 1178 | 1197 | AGAAACACCAAATCTTTGT | 39 | 9753 | 9772 | 484 |
| 544154 | 1183 | 1202 | CAAGTAGAAAACACCAAATC | 22 | 9758 | 9777 | 485 |
| 544155 | 1188 | 1207 | GATCCCAAGTAGAAAACACC | 5 | 9763 | 9782 | 486 |
| 544156 | 1195 | 1214 | GCTTTGTGATCCCAAGTAGA | 79 | 9770 | 9789 | 17 |
| 544157 | 1198 | 1217 | TTTGCTTTGTGATCCCAAGT | 80 | 9773 | 9792 | 487 |
| 544158 | 1202 | 1221 | TCCTTTTGCTTTGTGATCCC | 73 | 9777 | 9796 | 488 |
| 544159 | 1208 | 1227 | GAAGTGTCCTTTTGCTTTGT | 33 | 9783 | 9802 | 489 |

TABLE 4-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544160 | 1246 | 1265 | TGCCACCACCAGCCTCCTGA | 67 | N/A | N/A | 490 |
| 544161 | 1253 | 1272 | CTCATCATGCCACCACCAGC | 79 | 10225 | 10244 | 491 |
| 544162 | 1269 | 1288 | GGTTGTTTTCTCCACACTCA | 84 | 10241 | 10260 | 18 |
| 544163 | 1276 | 1295 | CCATTTAGGTTGTTTTCTCC | 34 | 10248 | 10267 | 492 |
| 544164 | 1283 | 1302 | ATATTTACCATTTAGGTTGT | 17 | 10255 | 10274 | 493 |
| 544165 | 1294 | 1313 | CTTGGTTTGTTATATTTACC | 76 | 10266 | 10285 | 494 |
| 544166 | 1353 | 1372 | ACCTTCCATTTTGAGACTTC | 79 | 10325 | 10344 | 19 |
| 544167 | 1363 | 1382 | ATAGAGTATAACCTTCCATT | 73 | 10335 | 10354 | 495 |
| 544168 | 1367 | 1386 | TTTTATAGAGTATAACCTTC | 41 | 10339 | 10358 | 496 |
| 544169 | 1374 | 1393 | TGGTTGATTTTATAGAGTAT | 53 | 10346 | 10365 | 497 |
| 544170 | 1378 | 1397 | ATTTTGGTTGATTTTATAGA | 28 | 10350 | 10369 | 498 |
| 544171 | 1383 | 1402 | TCAACATTTTGGTTGATTTT | 19 | 10355 | 10374 | 499 |
| 544172 | 1390 | 1409 | GGATGGATCAACATTTTGGT | 66 | 10362 | 10381 | 500 |
| 544173 | 1393 | 1412 | GTTGGATGGATCAACATTTT | 71 | 10365 | 10384 | 501 |
| 544174 | 1396 | 1415 | TCTGTTGGATGGATCAACAT | 35 | 10368 | 10387 | 502 |
| 544175 | 1401 | 1420 | CTGAATCTGTTGGATGGATC | 68 | 10373 | 10392 | 503 |
| 544176 | 1407 | 1426 | AGCTTTCTGAATCTGTTGGA | 70 | 10379 | 10398 | 504 |
| 544177 | 1414 | 1433 | CATTCAAAGCTTTCTGAATC | 35 | 10386 | 10405 | 505 |
| 544178 | 1417 | 1436 | GTTCATTCAAAGCTTTCTGA | 76 | 10389 | 10408 | 506 |
| 544179 | 1420 | 1439 | TCAGTTCATTCAAAGCTTTC | 15 | 10392 | 10411 | 507 |
| 544180 | 1423 | 1442 | GCCTCAGTTCATTCAAAGCT | 68 | 10395 | 10414 | 508 |
| 544181 | 1427 | 1446 | ATTTGCCTCAGTTCATTCAA | 67 | 10399 | 10418 | 509 |
| 544182 | 1431 | 1450 | TTAAATTTGCCTCAGTTCAT | 51 | 10403 | 10422 | 510 |
| 544183 | 1436 | 1455 | GCCTTTTAAATTTGCCTCAG | 80 | 10408 | 10427 | 511 |
| 544184 | 1498 | 1517 | AGGATTAATACCAGATTAT | 54 | 10470 | 10489 | 512 |
| 544185 | 1502 | 1521 | CTTAAGGATTAATACCAGA | 69 | 10474 | 10493 | 513 |
| 544186 | 1505 | 1524 | TCTCTTAAGGATTTAATACC | 58 | 10477 | 10496 | 514 |
| 544187 | 1546 | 1565 | GACAGTGACTTTAAGATAAA | 34 | 10518 | 10537 | 515 |
| 544188 | 1572 | 1591 | TGTGATTGTATGTTTAATCT | 47 | 10544 | 10563 | 516 |
| 544189 | 1578 | 1597 | AGGTTATGTGATTGTATGTT | 68 | 10550 | 10569 | 517 |
| 544190 | 1583 | 1602 | CTTTAAGGTTATGTGATTGT | 62 | 10555 | 10574 | 518 |
| 544191 | 1589 | 1608 | GGTATTCTTTAAGGTTATGT | 66 | 10561 | 10580 | 519 |
| 544192 | 1656 | 1675 | ATTGATTCCCACATCACAAA | 50 | 10628 | 10647 | 520 |
| 544193 | 1661 | 1680 | CTAAAATTGATTCCCACATC | 73 | 10633 | 10652 | 521 |
| 544194 | 1665 | 1684 | CCATCTAAAATTGATTCCCA | 73 | 10637 | 10656 | 522 |
| 544195 | 1771 | 1790 | TTGTGATATTAGCTCATATG | 57 | 10743 | 10762 | 523 |

TABLE 4-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544196 | 1794 | 1813 | ACTAGTTTTTTAAACTGGGA | 21 | 10766 | 10785 | 524 |
| 544197 | 1820 | 1839 | GTCAAGTTTAGAGTTTTAAC | 53 | 10792 | 10811 | 525 |
| 544198 | 1826 | 1845 | TATTTAGTCAAGTTTAGAGT | 11 | 10798 | 10817 | 526 |
| 544199 | 1907 | 1926 | TACACATACTCTGTGCTGAC | 84 | 10879 | 10898 | 20 |
| 544200 | 1913 | 1932 | GATTTTTACACATACTCTGT | 53 | 10885 | 10904 | 527 |
| 544201 | 2008 | 2027 | CTGCTTCATTAGGTTTCATA | 67 | 10980 | 10999 | 528 |

TABLE 5

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544127 | 765 | 784 | CAGCAGGAATGCCATCATGT | 18 | N/A | N/A | 529 |
| 544128 | 819 | 838 | TGATGGCATACATGCCACTT | 0 | 7404 | 7423 | 530 |
| 544129 | 828 | 847 | TGCTGGGTCTGATGGCATAC | 48 | 7413 | 7432 | 531 |
| 544130 | 832 | 851 | GAGTTGCTGGGTCTGATGGC | 14 | 7417 | 7436 | 532 |
| 544131 | 841 | 860 | AAAACTTGAGAGTTGCTGGG | 5 | 7426 | 7445 | 533 |
| 544132 | 848 | 867 | GACATGAAAAACTTGAGAGT | 0 | 7433 | 7452 | 534 |
| 544133 | 859 | 878 | ACATCACAGTAGACATGAAA | 28 | 7444 | 7463 | 535 |
| 233717 | 889 | 908 | TGAATTAATGTCCATGGACT | 51 | 7876 | 7895 | 14 |
| 544134 | 915 | 934 | AGTTTTGTGATCCATCTATT | 36 | 7902 | 7921 | 536 |
| 544135 | 918 | 937 | TGAAGTTTTGTGATCCATCT | 61 | 7905 | 7924 | 537 |
| 544136 | 926 | 945 | CGTTTCATTGAAGTTTTGTG | 54 | 7913 | 7932 | 538 |
| 544137 | 946 | 965 | CCATATTTGTAGTTCTCCCA | 67 | 7933 | 7952 | 539 |
| 544138 | 949 | 968 | AAACCATATTTGTAGTTCTC | 39 | 7936 | 7955 | 540 |
| 544139 | 970 | 989 | AATTCTCCATCAAGCCTCCC | 77 | N/A | N/A | 541 |
| 233722 | 991 | 1010 | ATCTTCTCTAGGCCCAACCA | 95 | 9566 | 9585 | 542 |
| 544432 | 997 | 1016 | GAGTATATCTTCTCTAGGCC | 86 | 9572 | 9591 | 543 |
| 544140 | 1002 | 1021 | CTATGGAGTATATCTTCTCT | 57 | 9577 | 9596 | 544 |
| 544141 | 1008 | 1027 | GCTTCACTATGGAGTATATC | 52 | 9583 | 9602 | 545 |
| 544142 | 1013 | 1032 | AGATTGCTTCACTATGGAGT | 40 | 9588 | 9607 | 546 |
| 544143 | 1046 | 1065 | CCAGTCTTCCAACTCAATTC | 32 | 9621 | 9640 | 547 |
| 544144 | 1052 | 1071 | GTCTTTCCAGTCTTCCAACT | 53 | 9627 | 9646 | 548 |
| 544145 | 1055 | 1074 | GTTGTCTTTCCAGTCTTCCA | 80 | 9630 | 9649 | 16 |
| 544146 | 1059 | 1078 | GTTTGTTGTCTTTCCAGTCT | 59 | 9634 | 9653 | 549 |
| 544147 | 1062 | 1081 | AATGTTTGTTGTCTTTCCAG | 42 | 9637 | 9656 | 550 |

TABLE 5-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544148 | 1095 | 1114 | CGTGATTTCCCAAGTAAAAA | 76 | 9670 | 9689 | 551 |
| 544149 | 1160 | 1179 | GTTTTCCGGGATTGCATTGG | 29 | 9735 | 9754 | 552 |
| 544150 | 1165 | 1184 | TCTTTGTTTTCCGGGATTGC | 50 | 9740 | 9759 | 553 |
| 544151 | 1170 | 1189 | CCAAATCTTTGTTTTCCGGG | 56 | 9745 | 9764 | 554 |
| 544152 | 1173 | 1192 | ACACCAAATCTTTGTTTTCC | 26 | 9748 | 9767 | 555 |
| 544153 | 1178 | 1197 | AGAAAACACCAAATCTTTGT | 22 | 9753 | 9772 | 556 |
| 544154 | 1183 | 1202 | CAAGTAGAAAACACCAAATC | 29 | 9758 | 9777 | 557 |
| 544155 | 1188 | 1207 | GATCCCAAGTAGAAAACACC | 16 | 9763 | 9782 | 558 |
| 544156 | 1195 | 1214 | GCTTTGTGATCCCAAGTAGA | 71 | 9770 | 9789 | 17 |
| 544157 | 1198 | 1217 | TTTGCTTTGTGATCCCAAGT | 55 | 9773 | 9792 | 559 |
| 544158 | 1202 | 1221 | TCCTTTTGCTTTGTGATCCC | 51 | 9777 | 9796 | 560 |
| 544159 | 1208 | 1227 | GAAGTGTCCTTTTGCTTTGT | 8 | 9783 | 9802 | 561 |
| 544160 | 1246 | 1265 | TGCCACCACCAGCCTCCTGA | 68 | N/A | N/A | 562 |
| 544161 | 1253 | 1272 | CTCATCATGCCACCACCAGC | 48 | 10225 | 10244 | 563 |
| 544162 | 1269 | 1288 | GGTTGTTTTCTCCACACTCA | 74 | 10241 | 10260 | 18 |
| 544163 | 1276 | 1295 | CCATTTAGGTTGTTTTCTCC | 33 | 10248 | 10267 | 564 |
| 544164 | 1283 | 1302 | ATATTTACCATTTAGGTTGT | 0 | 10255 | 10274 | 565 |
| 544165 | 1294 | 1313 | CTTGGTTTGTTATATTTACC | 52 | 10266 | 10285 | 566 |
| 544166 | 1353 | 1372 | ACCTTCCATTTTGAGACTTC | 69 | 10325 | 10344 | 19 |
| 544167 | 1363 | 1382 | ATAGAGTATAACCTTCCATT | 72 | 10335 | 10354 | 567 |
| 544168 | 1367 | 1386 | TTTTATAGAGTATAACCTTC | 27 | 10339 | 10358 | 568 |
| 544169 | 1374 | 1393 | TGGTTGATTTTATAGAGTAT | 39 | 10346 | 10365 | 569 |
| 544170 | 1378 | 1397 | ATTTTGGTTGATTTTATAGA | 7 | 10350 | 10369 | 570 |
| 544171 | 1383 | 1402 | TCAACATTTTGGTTGATTTT | 0 | 10355 | 10374 | 571 |
| 544172 | 1390 | 1409 | GGATGGATCAACATTTTGGT | 48 | 10362 | 10381 | 572 |
| 544173 | 1393 | 1412 | GTTGGATGGATCAACATTTT | 51 | 10365 | 10384 | 573 |
| 544174 | 1396 | 1415 | TCTGTTGGATGGATCAACAT | 46 | 10368 | 10387 | 574 |
| 544175 | 1401 | 1420 | CTGAATCTGTTGGATGGATC | 58 | 10373 | 10392 | 575 |
| 544176 | 1407 | 1426 | AGCTTTCTGAATCTGTTGGA | 57 | 10379 | 10398 | 576 |
| 544177 | 1414 | 1433 | CATTCAAAGCTTTCTGAATC | 0 | 10386 | 10405 | 577 |
| 544178 | 1417 | 1436 | GTTCATTCAAAGCTTTCTGA | 62 | 10389 | 10408 | 578 |
| 544179 | 1420 | 1439 | TCAGTTCATTCAAAGCTTTC | 21 | 10392 | 10411 | 579 |
| 544180 | 1423 | 1442 | GCCTCAGTTCATTCAAAGCT | 73 | 10395 | 10414 | 580 |
| 544181 | 1427 | 1446 | ATTTGCCTCAGTTCATTCAA | 46 | 10399 | 10418 | 581 |
| 544182 | 1431 | 1450 | TTAAATTTGCCTCAGTTCAT | 52 | 10403 | 10422 | 582 |
| 544183 | 1436 | 1455 | GCCTTTTAAATTTGCCTCAG | 66 | 10408 | 10427 | 583 |

TABLE 5-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544184 | 1498 | 1517 | AGGATTTAATACCAGATTAT | 31 | 10470 | 10489 | 584 |
| 544185 | 1502 | 1521 | CTTAAGGATTTAATACCAGA | 49 | 10474 | 10493 | 585 |
| 544186 | 1505 | 1524 | TCTCTTAAGGATTTAATACC | 49 | 10477 | 10496 | 586 |
| 544187 | 1546 | 1565 | GACAGTGACTTTAAGATAAA | 27 | 10518 | 10537 | 587 |
| 544188 | 1572 | 1591 | TGTGATTGTATGTTTAATCT | 30 | 10544 | 10563 | 588 |
| 544189 | 1578 | 1597 | AGGTTATGTGATTGTATGTT | 35 | 10550 | 10569 | 589 |
| 544190 | 1583 | 1602 | CTTTAAGGTTATGTGATTGT | 50 | 10555 | 10574 | 590 |
| 544191 | 1589 | 1608 | GGTATTCTTTAAGGTTATGT | 54 | 10561 | 10580 | 591 |
| 544192 | 1656 | 1675 | ATTGATTCCCACATCACAAA | 47 | 10628 | 10647 | 592 |
| 544193 | 1661 | 1680 | CTAAAATTGATTCCCACATC | 69 | 10633 | 10652 | 593 |
| 544194 | 1665 | 1684 | CCATCTAAAATTGATTCCCA | 74 | 10637 | 10656 | 594 |
| 544195 | 1771 | 1790 | TTGTGATATTAGCTCATATG | 54 | 10743 | 10762 | 595 |
| 544196 | 1794 | 1813 | ACTAGTTTTTAAACTGGGA | 27 | 10766 | 10785 | 596 |
| 544197 | 1820 | 1839 | GTCAAGTTTAGAGTTTTAAC | 18 | 10792 | 10811 | 597 |
| 544198 | 1826 | 1845 | TATTTAGTCAAGTTTAGAGT | 12 | 10798 | 10817 | 598 |
| 544199 | 1907 | 1926 | TACACATACTCTGTGCTGAC | 83 | 10879 | 10898 | 20 |
| 544200 | 1913 | 1932 | GATTTTACACATACTCTGT | 58 | 10885 | 10904 | 599 |
| 544201 | 2008 | 2027 | CTGCTTCATTAGGTTTCATA | 62 | 10980 | 10999 | 600 |

TABLE 6

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 337520 | N/A | N/A | CAGTGTTATTCAGATTGTAC | 64 | 6517 | 6536 | 601 |
| 337521 | N/A | N/A | AGTGTCTTACCATCATGTTT | 40 | 6776 | 6795 | 602 |
| 337525 | N/A | N/A | CACCAGCCTCCTAAAGGAGA | 39 | 10212 | 10231 | 603 |
| 544292 | N/A | N/A | GAGGAGGTGAAGTCAGTGAG | 35 | 4815 | 4834 | 604 |
| 544293 | N/A | N/A | TAGAGTAGAGGAGGTGAAGT | 23 | 4822 | 4841 | 605 |
| 544294 | N/A | N/A | TGTTTGATGTGTTTGAATAC | 19 | 4863 | 4882 | 606 |
| 544295 | N/A | N/A | GAAACAACAAGGGCAAAGGC | 23 | 4898 | 4917 | 607 |
| 544296 | N/A | N/A | TGTTTGATAACGACCCTAAG | 43 | 4974 | 4993 | 608 |
| 544297 | N/A | N/A | TTTTTGGTTAAGTGACCTTG | 48 | 5016 | 5035 | 609 |
| 544298 | N/A | N/A | GTAGAAGTTTTCAGGGATGG | 23 | 5052 | 5071 | 610 |
| 544299 | N/A | N/A | AGGAAGTAGAAGTTTTCAGG | 5 | 5057 | 5076 | 611 |

TABLE 6-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544300 | N/A | N/A | AGGTGAGTGTGCAGGAGAAA | 11 | 5085 | 5104 | 612 |
| 544301 | N/A | N/A | TTAAATAAGGTGAGTGTGC | 14 | 5093 | 5112 | 613 |
| 544302 | N/A | N/A | AGTGCAGGAATAGAAGAGAT | 35 | 5136 | 5155 | 614 |
| 544303 | N/A | N/A | CATTTTAGTGCAGGAATAGA | 21 | 5142 | 5161 | 615 |
| 544306 | N/A | N/A | CTATATTCTGGAGTATATAC | 39 | 5216 | 5235 | 616 |
| 544307 | N/A | N/A | CAGTATTCTATATTCTGGAG | 72 | 5223 | 5242 | 617 |
| 544308 | N/A | N/A | GTGCCATACAGTATTCTATA | 50 | 5231 | 5250 | 618 |
| 544309 | N/A | N/A | CTGTGTGAATATGACATTAC | 52 | 5281 | 5300 | 619 |
| 544310 | N/A | N/A | TGAGGCACACTATTTCTAGT | 47 | 5333 | 5352 | 620 |
| 544311 | N/A | N/A | GACCTTTAATTATGAGGCAC | 67 | 5345 | 5364 | 621 |
| 544312 | N/A | N/A | GAATGTTGACCTTTAATTAT | 23 | 5352 | 5371 | 622 |
| 544313 | N/A | N/A | TTGTTGAATGTTGACCTTTA | 69 | 5357 | 5376 | 623 |
| 544314 | N/A | N/A | TCTACTAAGTAACTATGTGA | 37 | 5915 | 5934 | 624 |
| 544315 | N/A | N/A | CTCTTTTCTACTAAGTAACT | 31 | 5921 | 5940 | 625 |
| 544316 | N/A | N/A | AAGGATCTATTGTAAAGTTT | 24 | 5956 | 5975 | 626 |
| 544317 | N/A | N/A | CTAGGACCTTATTTAAAAGG | 24 | 5972 | 5991 | 627 |
| 544318 | N/A | N/A | ATTTCCTAGGACCTTATTTA | 8 | 5977 | 5996 | 628 |
| 544319 | N/A | N/A | TTGACAGTAAGAAAAGCAGA | 28 | 6051 | 6070 | 629 |
| 544320 | N/A | N/A | TTCTCATTGACAGTAAGAAA | 56 | 6057 | 6076 | 630 |
| 544321 | N/A | N/A | AGTTTTTCTCATTGACAGTA | 50 | 6062 | 6081 | 631 |
| 544322 | N/A | N/A | ATTGAATGATAGTTTTTCTC | 42 | 6072 | 6091 | 632 |
| 544323 | N/A | N/A | TTGGGTTTGCAATTTATTGA | 36 | 6087 | 6106 | 633 |
| 544324 | N/A | N/A | AGTGTGTTGGGTTTGCAATT | 25 | 6093 | 6112 | 634 |
| 544325 | N/A | N/A | TATTTAAGTGTGTTGGGTTT | 27 | 6099 | 6118 | 635 |
| 544326 | N/A | N/A | ATATATTCAGTAGTTTATCG | 25 | 6145 | 6164 | 636 |
| 544327 | N/A | N/A | AGATGTTGGCAGGTTGGCAA | 51 | 6184 | 6203 | 637 |
| 544328 | N/A | N/A | TCTGTAGATGTTGGCAGGTT | 48 | 6189 | 6208 | 638 |
| 544329 | N/A | N/A | TTGATAATTTTTGACCTGTA | 34 | 6215 | 6234 | 639 |
| 544330 | N/A | N/A | GGCTTTCTTGATAATTTGAT | 52 | 6230 | 6249 | 640 |
| 544331 | N/A | N/A | GTCTTACTGATCTTCAGACC | 27 | 6282 | 6301 | 641 |
| 544332 | N/A | N/A | TTTAGGTCTTACTGATCTTC | 14 | 6287 | 6306 | 642 |
| 544333 | N/A | N/A | TCAGTTTTAGGTCTTACTGA | 28 | 6292 | 6311 | 643 |
| 544334 | N/A | N/A | TGATATTCTGTTCAGATTTT | 44 | 6326 | 6345 | 644 |
| 544335 | N/A | N/A | TAGAGACTGCTTTGCTTAGA | 31 | 6388 | 6407 | 645 |
| 544336 | N/A | N/A | AGGCCAAAAGTAGAGACTGC | 29 | 6398 | 6417 | 646 |
| 544337 | N/A | N/A | GGCAAAAAAGCAGACATTGG | 38 | 6433 | 6452 | 647 |

TABLE 6-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544338 | N/A | N/A | AATCAGGGACATTATTTAAT | 13 | 6473 | 6492 | 648 |
| 544339 | N/A | N/A | TATTTAATCAGGGACATTAT | 28 | 6478 | 6497 | 649 |
| 544340 | N/A | N/A | CTCAAAATATTTAATCAGGG | 27 | 6485 | 6504 | 650 |
| 544341 | N/A | N/A | TACCTGTTCTCAAAATATTT | 18 | 6493 | 6512 | 651 |
| 544342 | N/A | N/A | GTACAGATTACCTGTTCTCA | 68 | 6501 | 6520 | 652 |
| 544343 | N/A | N/A | GGTGTTTGATATTTAGATAA | 25 | 6538 | 6557 | 653 |
| 544344 | N/A | N/A | TTGTCTTTCAGTTCATAATG | 29 | 6565 | 6584 | 654 |
| 544345 | N/A | N/A | ACAGTTTGTCTTTCAGTTCA | 23 | 6570 | 6589 | 655 |
| 544346 | N/A | N/A | TCTGAGCTGATAAAAGAATA | 15 | 6657 | 6676 | 656 |
| 544347 | N/A | N/A | CCCACCAAAGTGTCTTACCA | 49 | 6784 | 6803 | 657 |
| 544348 | N/A | N/A | CTTCAAGAAGGAAACCCACC | 39 | 6798 | 6817 | 658 |
| 544349 | N/A | N/A | AATAGCTTCAAGAAGGAAAC | 12 | 6803 | 6822 | 659 |
| 544350 | N/A | N/A | ACAAGTCCTAAGAATAGGGA | 25 | 6833 | 6852 | 660 |
| 544351 | N/A | N/A | GTCTAGAACAAGTCCTAAGA | 53 | 6840 | 6859 | 661 |
| 544352 | N/A | N/A | TCTAATAATCAAGTCCATAT | 33 | 6972 | 6991 | 662 |
| 544353 | N/A | N/A | ACCTTCTATATTATCTAATA | 19 | 6985 | 7004 | 663 |
| 544354 | N/A | N/A | GCATGTATCTCTTAAACAGG | 50 | 7060 | 7079 | 664 |
| 544355 | N/A | N/A | TTTCAGCATGTATCTCTTAA | 79 | 7065 | 7084 | 21 |
| 544356 | N/A | N/A | GTCCAGTGACCTTTAACTCC | 69 | 7092 | 7111 | 665 |
| 544357 | N/A | N/A | TCTTACCAAACTATTTTCTT | 28 | 7166 | 7185 | 666 |
| 544358 | N/A | N/A | GTAATGTTTATGTTAAAGCA | 17 | 7226 | 7245 | 667 |
| 544359 | N/A | N/A | TTGTGGCAAATGTAGCATTT | 52 | 7251 | 7270 | 668 |
| 544360 | N/A | N/A | GAGATTTCACTTGACATTTT | 30 | 7277 | 7296 | 669 |
| 544361 | N/A | N/A | GGAGCTTGAGATTTCACTTG | 30 | 7284 | 7303 | 670 |
| 544362 | N/A | N/A | CATCAGATTAGTAATAGGA | 0 | 7315 | 7334 | 671 |
| 544363 | N/A | N/A | GTTATTACATCAGATTTAGT | 6 | 7322 | 7341 | 672 |
| 544365 | N/A | N/A | CAGCAGGAATGCCTAGAATC | 32 | 7350 | 7369 | 673 |
| 544366 | N/A | N/A | CTCCTTAGACAGGTTTTACC | 31 | 7471 | 7490 | 674 |
| 544367 | N/A | N/A | GTCTATTCTCCTTAGACAGG | 23 | 7478 | 7497 | 675 |
| 544368 | N/A | N/A | ACCAGGTTAATCTTCCTAAT | 71 | 7526 | 7545 | 22 |
| 544369 | N/A | N/A | ATGAATGATTGAATGTAGTC | 26 | 7977 | 7996 | 676 |
| 544370 | N/A | N/A | ATATGAAGGCTGAGACTGCT | 58 | 8072 | 8091 | 677 |
| 544371 | N/A | N/A | ATAAATTATATGAAGGCTGA | 7 | 8079 | 8098 | 678 |
| 544372 | N/A | N/A | ATATTTAAGAACAGACATGT | 12 | 8175 | 8194 | 679 |
| 544373 | N/A | N/A | AGTTATGATCATTGTAAGCC | 60 | 8217 | 8236 | 23 |
| 544374 | N/A | N/A | ATTTGTAACAGTTACTACTT | 51 | 8276 | 8295 | 680 |

TABLE 6-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544375 | N/A | N/A | CACAGCTTATTTGTAACAGT | 70 | 8284 | 8303 | 681 |
| 544376 | N/A | N/A | GGAGTGGTTCTTTTCACAGC | 71 | 8298 | 8317 | 24 |
| 544377 | N/A | N/A | GTGACTAATGCTAGGAGTGG | 34 | 8311 | 8330 | 682 |
| 544378 | N/A | N/A | GAATAGAGTGACTAATGCTA | 45 | 8318 | 8337 | 683 |
| 544379 | N/A | N/A | ATGAGAGAATAGAGTGACTA | 58 | 8324 | 8343 | 684 |
| 544380 | N/A | N/A | TGGTCCTTTTAACTTCCAAT | 70 | 8365 | 8384 | 25 |
| 544381 | N/A | N/A | TATACTGTATGTCTGAGTTT | 66 | 8387 | 8406 | 685 |
| 544382 | N/A | N/A | AACTAATTCATTATAAGCCA | 67 | 8450 | 8469 | 686 |
| 544383 | N/A | N/A | GCATTGAGTTAACTAATTCA | 64 | 8460 | 8479 | 26 |
| 544385 | N/A | N/A | TTTGGATTTTAAACATCTGT | 61 | 8528 | 8547 | 687 |
| 544386 | N/A | N/A | TGTATGTGCTTTTTGGATTT | 37 | 8539 | 8558 | 688 |
| 544387 | N/A | N/A | CATGGATTTTTGTATGTGCT | 62 | 8549 | 8568 | 689 |
| 544388 | N/A | N/A | TCATTCATGGATTTTTGTAT | 34 | 8554 | 8573 | 690 |
| 544389 | N/A | N/A | ACTTAGACATCATTCATGGA | 55 | 8563 | 8582 | 691 |
| 544390 | N/A | N/A | GTGAGTACTTAGACATCATT | 66 | 8569 | 8588 | 692 |
| 544391 | N/A | N/A | TTTATAAGTGAGTACTTAGA | 36 | 8576 | 8595 | 693 |
| 544392 | N/A | N/A | GTCTTCTACTTTATAAGTGA | 65 | 8585 | 8604 | 694 |
| 544393 | N/A | N/A | ATGAATGTCTTCTACTTTAT | 34 | 8591 | 8610 | 695 |
| 544394 | N/A | N/A | CAAATAGTACTGAGCATTTA | 30 | 8627 | 8646 | 696 |
| 544395 | N/A | N/A | TTAGAAGATTTGGAGCTACA | 54 | 8718 | 8737 | 697 |
| 544396 | N/A | N/A | TCACTATTAGAAGATTTGGA | 37 | 8724 | 8743 | 698 |
| 544397 | N/A | N/A | GGGTTACACTCACTATTAGA | 36 | 8733 | 8752 | 699 |
| 544398 | N/A | N/A | ACTTACCTGTCAGCCTTTTA | 54 | 8758 | 8777 | 700 |
| 544399 | N/A | N/A | CTTACCAGAATTAAGTGAGT | 26 | 8785 | 8804 | 701 |
| 544400 | N/A | N/A | AATACAAGTACAAATGGGTT | 22 | 8810 | 8829 | 702 |
| 544401 | N/A | N/A | CTGGTAAATACAAGTACAAA | 55 | 8816 | 8835 | 703 |
| 544402 | N/A | N/A | GGATTGCTGGTAAATACAAG | 40 | 8822 | 8841 | 704 |
| 544403 | N/A | N/A | TCATTTTAAGGATTGCTGGT | 62 | 8831 | 8850 | 705 |
| 544404 | N/A | N/A | AGTTAGTAGGAAGCTTCATT | 56 | 8846 | 8865 | 706 |
| 544405 | N/A | N/A | GCTATTGAGTTAGTAGGAAG | 67 | 8853 | 8872 | 707 |
| 544407 | N/A | N/A | AGCATGGTTCTTAATAACTT | 67 | 9012 | 9031 | 708 |
| 544408 | N/A | N/A | CTTTGTAGAAAAAGACAGGA | 27 | 9062 | 9081 | 709 |
| 544409 | N/A | N/A | ACCTGGCCTTTGGTATTTGC | 49 | 9096 | 9115 | 710 |
| 544410 | N/A | N/A | CATCCATATACAGTCAAGAG | 80 | 9174 | 9193 | 27 |
| 544411 | N/A | N/A | AGTCTTTATATGGATAAACT | 15 | 9215 | 9234 | 711 |
| 544412 | N/A | N/A | CGTCATTGGTAGAGGAATAT | 51 | 9240 | 9259 | 712 |

TABLE 6-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544413 | N/A | N/A | GATTATCCTTTCTATAATGC | 48 | 9321 | 9340 | 713 |
| 544414 | N/A | N/A | GTCTTGAATCCCTTGATCAT | 40 | 9436 | 9455 | 714 |
| 544415 | N/A | N/A | GGTGCAACTAATTGAGTTGT | 27 | 9459 | 9478 | 715 |
| 544416 | N/A | N/A | GTGTTTTTATTGGTGCAAC | 31 | 9471 | 9490 | 716 |
| 544417 | N/A | N/A | ATTCTCCTGAAAAGAAAAGT | 24 | 9544 | 9563 | 717 |
| 544418 | N/A | N/A | ATGCCACCACCAGCCTCCTA | 73 | 10219 | 10238 | 718 |
| 544419 | N/A | N/A | ATATCCTTTAACAAATGGGT | 62 | 11540 | 11559 | 719 |
| 544420 | N/A | N/A | GCACTATATCCTTTAACAAA | 50 | 11545 | 11564 | 720 |
| 544421 | N/A | N/A | ACTTGGGCACTATATCCTTT | 68 | 11551 | 11570 | 721 |
| 544422 | N/A | N/A | GAAACATGTCCTATGAGAGT | 32 | 11918 | 11937 | 722 |
| 544424 | N/A | N/A | TTGAGCACTTTAAGCAAAGT | 7 | 12070 | 12089 | 723 |
| 544425 | N/A | N/A | GGAATTTGAGCACTTTAAGC | 34 | 12075 | 12094 | 724 |
| 544426 | N/A | N/A | TAGATTAGACAACTGTGAGT | 52 | 12101 | 12120 | 725 |
| 544427 | N/A | N/A | AAAATGAAGGTCAAGTTTGA | 17 | 12197 | 12216 | 726 |
| 544428 | N/A | N/A | GTGAAAGCAAAATGAAGGTC | 33 | 12205 | 12224 | 727 |
| 544429 | N/A | N/A | GTATTGTGAAAGCAAAATGA | 39 | 12210 | 12229 | 728 |
| 544430 | N/A | N/A | TGGAGAGTATAGTATTGTGA | 35 | 12221 | 12240 | 729 |
| 544438 | N/A | N/A | AGGAATAGAAGAGATAAATA | 10 | 5131 | 5150 | 730 |
| 544439 | N/A | N/A | TGGAGTATATACAAATAATG | 30 | 5208 | 5227 | 731 |
| 544440 | N/A | N/A | TGTTTACATTGTAGATTAAT | 15 | 5381 | 5400 | 732 |
| 544441 | N/A | N/A | CAGAATATATAATATCTTGC | 57 | 6035 | 6054 | 733 |
| 544442 | N/A | N/A | TGCAATTTATTGAATGATAG | 31 | 6080 | 6099 | 734 |
| 544443 | N/A | N/A | CATAATACATAATTTGAACC | 0 | 6251 | 6270 | 735 |
| 544444 | N/A | N/A | ATAATTTTCAGTTTTAGGTC | 0 | 6299 | 6318 | 736 |
| 544445 | N/A | N/A | TTTCAGTAATGTTTATGTTA | 9 | 7231 | 7250 | 737 |
| 544446 | N/A | N/A | AATGCCTAGAATCAATAAAA | 36 | 7343 | 7362 | 738 |
| 544447 | N/A | N/A | GTAAATATTTGTAGATTAGC | 49 | 8003 | 8022 | 739 |
| 544448 | N/A | N/A | ACAAATGTGTAATTGTTTGA | 25 | 8101 | 8120 | 740 |
| 544449 | N/A | N/A | TACTAACAAATGTGTAATTG | 35 | 8106 | 8125 | 741 |
| 544450 | N/A | N/A | TGATAAGTATATTTAAGAAC | 35 | 8183 | 8202 | 742 |
| 544451 | N/A | N/A | TTAACTTCCAATTAATTGAT | 29 | 8357 | 8376 | 743 |
| 544452 | N/A | N/A | TCTGTTATTTTATCTTGCTT | 67 | 8513 | 8532 | 744 |
| 544453 | N/A | N/A | ATCACAATCCTTTTTATTAA | 18 | 8921 | 8940 | 745 |
| 544454 | N/A | N/A | AGAGACTTGAGTAATAATAA | 25 | 9137 | 9156 | 746 |
| 544455 | N/A | N/A | AACAAAATGAAACATGTCCT | 59 | 11926 | 11945 | 747 |
| 544127 | 765 | 784 | CAGCAGGAATGCCATCATGT | 33 | N/A | N/A | 748 |

TABLE 6-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544128 | 819 | 838 | TGATGGCATACATGCCACTT | 13 | 7404 | 7423 | 749 |
| 544129 | 828 | 847 | TGCTGGGTCTGATGGCATAC | 53 | 7413 | 7432 | 750 |
| 544130 | 832 | 851 | GAGTTGCTGGGTCTGATGGC | 22 | 7417 | 7436 | 751 |
| 544131 | 841 | 860 | AAAACTTGAGAGTTGCTGGG | 13 | 7426 | 7445 | 752 |
| 544132 | 848 | 867 | GACATGAAAAACTTGAGAGT | 0 | 7433 | 7452 | 753 |
| 544133 | 859 | 878 | ACATCACAGTAGACATGAAA | 27 | 7444 | 7463 | 754 |
| 233717 | 889 | 908 | TGAATTAATGTCCATGGACT | 58 | 7876 | 7895 | 14 |
| 544134 | 915 | 934 | AGTTTTGTGATCCATCTATT | 46 | 7902 | 7921 | 755 |
| 544135 | 918 | 937 | TGAAGTTTTGTGATCCATCT | 54 | 7905 | 7924 | 756 |
| 544136 | 926 | 945 | CGTTTCATTGAAGTTTTGTG | 40 | 7913 | 7932 | 757 |
| 544137 | 946 | 965 | CCATATTTGTAGTTCTCCCA | 45 | 7933 | 7952 | 758 |
| 544138 | 949 | 968 | AAACCATATTTGTAGTTCTC | 41 | 7936 | 7955 | 759 |
| 544139 | 970 | 989 | AATTCTCCATCAAGCCTCCC | 43 | N/A | N/A | 760 |
| 233722 | 991 | 1010 | ATCTTCTCTAGGCCCAACCA | 65 | 9566 | 9585 | 761 |
| 544432 | 997 | 1016 | GAGTATATCTTCTCTAGGCC | 40 | 9572 | 9591 | 762 |
| 544140 | 1002 | 1021 | CTATGGAGTATATCTTCTCT | 28 | 9577 | 9596 | 763 |
| 544141 | 1008 | 1027 | GCTTCACTATGGAGTATATC | 55 | 9583 | 9602 | 764 |
| 544142 | 1013 | 1032 | AGATTGCTTCACTATGGAGT | 47 | 9588 | 9607 | 765 |
| 544143 | 1046 | 1065 | CCAGTCTTCCAACTCAATTC | 33 | 9621 | 9640 | 766 |
| 544144 | 1052 | 1071 | GTCTTTCCAGTCTTCCAACT | 59 | 9627 | 9646 | 767 |
| 544145 | 1055 | 1074 | GTTGTCTTTCCAGTCTTCCA | 77 | 9630 | 9649 | 16 |
| 544146 | 1059 | 1078 | GTTTGTTGTCTTTCCAGTCT | 58 | 9634 | 9653 | 768 |
| 544147 | 1062 | 1081 | AATGTTTGTTGTCTTTCCAG | 43 | 9637 | 9656 | 769 |
| 544148 | 1095 | 1114 | CGTGATTTCCCAAGTAAAAA | 57 | 9670 | 9689 | 770 |
| 544149 | 1160 | 1179 | GTTTTCCGGGATTGCATTGG | 44 | 9735 | 9754 | 771 |
| 544150 | 1165 | 1184 | TCTTTGTTTTCCGGGATTGC | 53 | 9740 | 9759 | 772 |
| 544151 | 1170 | 1189 | CCAAATCTTTGTTTTCCGGG | 57 | 9745 | 9764 | 773 |
| 544152 | 1173 | 1192 | ACACCAAATCTTTGTTTTCC | 44 | 9748 | 9767 | 774 |
| 544153 | 1178 | 1197 | AGAAAACACCAAATCTTTGT | 36 | 9753 | 9772 | 775 |
| 544154 | 1183 | 1202 | CAAGTAGAAAACACCAAATC | 29 | 9758 | 9777 | 776 |
| 544155 | 1188 | 1207 | GATCCCAAGTAGAAAACACC | 29 | 9763 | 9782 | 777 |
| 544156 | 1195 | 1214 | GCTTTGTGATCCCAAGTAGA | 71 | 9770 | 9789 | 17 |
| 544157 | 1198 | 1217 | TTTGCTTTGTGATCCCAAGT | 66 | 9773 | 9792 | 778 |
| 544158 | 1202 | 1221 | TCCTTTTGCTTTGTGATCCC | 53 | 9777 | 9796 | 779 |
| 544159 | 1208 | 1227 | GAAGTGTCCTTTTGCTTTGT | 10 | 9783 | 9802 | 780 |
| 544160 | 1246 | 1265 | TGCCACCACCAGCCTCCTGA | 65 | N/A | N/A | 781 |

TABLE 6-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544161 | 1253 | 1272 | CTCATCATGCCACCACCAGC | 59 | 10225 | 10244 | 782 |
| 544162 | 1269 | 1288 | GGTTGTTTTCTCCACACTCA | 74 | 10241 | 10260 | 18 |
| 544163 | 1276 | 1295 | CCATTTAGGTTGTTTTCTCC | 38 | 10248 | 10267 | 783 |
| 544164 | 1283 | 1302 | ATATTTACCATTTAGGTTGT | 13 | 10255 | 10274 | 784 |
| 544165 | 1294 | 1313 | CTTGGTTTGTTATATTTACC | 53 | 10266 | 10285 | 785 |
| 544166 | 1353 | 1372 | ACCTTCCATTTTGAGACTTC | 70 | 10325 | 10344 | 19 |
| 544167 | 1363 | 1382 | ATAGAGTATAACCTTCCATT | 69 | 10335 | 10354 | 786 |
| 544168 | 1367 | 1386 | TTTTATAGAGTATAACCTTC | 34 | 10339 | 10358 | 787 |
| 544169 | 1374 | 1393 | TGGTTGATTTTATAGAGTAT | 38 | 10346 | 10365 | 788 |
| 544170 | 1378 | 1397 | ATTTTGGTTGATTTTATAGA | 0 | 10350 | 10369 | 789 |
| 544171 | 1383 | 1402 | TCAACATTTTGGTTGATTTT | 12 | 10355 | 10374 | 790 |
| 544172 | 1390 | 1409 | GGATGGATCAACATTTTGGT | 58 | 10362 | 10381 | 791 |
| 544173 | 1393 | 1412 | GTTGGATGGATCAACATTTT | 66 | 10365 | 10384 | 792 |
| 544174 | 1396 | 1415 | TCTGTTGGATGGATCAACAT | 49 | 10368 | 10387 | 793 |
| 544175 | 1401 | 1420 | CTGAATCTGTTGGATGGATC | 60 | 10373 | 10392 | 794 |
| 544176 | 1407 | 1426 | AGCTTTCTGAATCTGTTGGA | 64 | 10379 | 10398 | 795 |
| 544177 | 1414 | 1433 | CATTCAAAGCTTTCTGAATC | 21 | 10386 | 10405 | 796 |
| 544178 | 1417 | 1436 | GTTCATTCAAAGCTTTCTGA | 60 | 10389 | 10408 | 797 |
| 544179 | 1420 | 1439 | TCAGTTCATTCAAAGCTTTC | 18 | 10392 | 10411 | 798 |
| 544180 | 1423 | 1442 | GCCTCAGTTCATTCAAAGCT | 72 | 10395 | 10414 | 799 |
| 544181 | 1427 | 1446 | ATTTGCCTCAGTTCATTCAA | 51 | 10399 | 10418 | 800 |
| 544182 | 1431 | 1450 | TTAAATTTGCCTCAGTTCAT | 48 | 10403 | 10422 | 801 |
| 544183 | 1436 | 1455 | GCCTTTTAAATTTGCCTCAG | 70 | 10408 | 10427 | 802 |
| 544184 | 1498 | 1517 | AGGATTAATACCAGATTAT | 44 | 10470 | 10489 | 803 |
| 544185 | 1502 | 1521 | CTTAAGGATTTAATACCAGA | 47 | 10474 | 10493 | 804 |
| 544186 | 1505 | 1524 | TCTCTTAAGGATTTAATACC | 44 | 10477 | 10496 | 805 |
| 544187 | 1546 | 1565 | GACAGTGACTTTAAGATAAA | 38 | 10518 | 10537 | 806 |
| 544188 | 1572 | 1591 | TGTGATTGTATGTTTAATCT | 47 | 10544 | 10563 | 807 |
| 544189 | 1578 | 1597 | AGGTTATGTGATTGTATGTT | 43 | 10550 | 10569 | 808 |
| 544190 | 1583 | 1602 | CTTTAAGGTTATGTGATTGT | 42 | 10555 | 10574 | 809 |
| 544191 | 1589 | 1608 | GGTATTCTTTAAGGTTATGT | 60 | 10561 | 10580 | 810 |
| 544192 | 1656 | 1675 | ATTGATTCCCACATCACAAA | 46 | 10628 | 10647 | 811 |
| 544193 | 1661 | 1680 | CTAAAATTGATTCCCACATC | 65 | 10633 | 10652 | 812 |
| 544194 | 1665 | 1684 | CCATCTAAAATTGATTCCCA | 70 | 10637 | 10656 | 813 |
| 544195 | 1771 | 1790 | TTGTGATATTAGCTCATATG | 56 | 10743 | 10762 | 814 |
| 544196 | 1794 | 1813 | ACTAGTTTTTTAAACTGGGA | 33 | 10766 | 10785 | 815 |

TABLE 6-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544197 | 1820 | 1839 | GTCAAGTTTAGAGTTTTAAC | 39 | 10792 | 10811 | 816 |
| 544198 | 1826 | 1845 | TATTTAGTCAAGTTTAGAGT | 21 | 10798 | 10817 | 817 |
| 544199 | 1907 | 1926 | TACACATACTCTGTGCTGAC | 80 | 10879 | 10898 | 20 |
| 544200 | 1913 | 1932 | GATTTTTACACATACTCTGT | 56 | 10885 | 10904 | 818 |
| 544201 | 2008 | 2027 | CTGCTTCATTAGGTTTCATA | 65 | 10980 | 10999 | 819 |

TABLE 7

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 337525 | N/A | N/A | CACCAGCCTCCTAAAGGAGA | 58 | 10212 | 10231 | 820 |
| 544204 | N/A | N/A | GACTTCTTAACTCTATATAT | 67 | 3076 | 3095 | 821 |
| 544205 | N/A | N/A | CTAGACTTCTTAACTCTATA | 61 | 3079 | 3098 | 822 |
| 544206 | N/A | N/A | GACCTAGACTTCTTAACTCT | 54 | 3082 | 3101 | 823 |
| 544207 | N/A | N/A | GGAAGCAGACCTAGACTTCT | 58 | 3089 | 3108 | 824 |
| 544208 | N/A | N/A | TCTGGAAGCAGACCTAGACT | 48 | 3092 | 3111 | 825 |
| 544209 | N/A | N/A | TCTTCTGGAAGCAGACCTAG | 54 | 3095 | 3114 | 826 |
| 544210 | N/A | N/A | CTAATCTTTAGGGATTTAGG | 57 | 11433 | 11452 | 827 |
| 544211 | N/A | N/A | TGTATCTAATCTTTAGGGAT | 53 | 11438 | 11457 | 828 |
| 544213 | N/A | N/A | TAACTTGGGCACTATATCCT | 74 | 11553 | 11572 | 829 |
| 544214 | N/A | N/A | ATTGACAAAGGTAGGTCACC | 79 | 11576 | 11595 | 830 |
| 544215 | N/A | N/A | ATATGACATGTATATTGGAT | 66 | 11620 | 11639 | 831 |
| 544216 | N/A | N/A | TTTTGTACTTTTCTGGAACA | 61 | 11704 | 11723 | 832 |
| 544217 | N/A | N/A | TAGTCTGTGGTCCTGAAAAT | 56 | 11748 | 11767 | 833 |
| 544218 | N/A | N/A | AGCTTAGTCTGTGGTCCTGA | 72 | 11752 | 11771 | 834 |
| 544219 | N/A | N/A | GACAGCTTAGTCTGTGGTCC | 74 | 11755 | 11774 | 835 |
| 544220 | N/A | N/A | GTATTCTGGCCCTAAAAAAA | 52 | 11789 | 11808 | 836 |
| 544221 | N/A | N/A | ATTTGGTATTCTGGCCCTA | 56 | 11795 | 11814 | 837 |
| 544222 | N/A | N/A | GAAATTGTCCAATTTTTGGG | 56 | N/A | N/A | 838 |
| 544223 | N/A | N/A | TTTGCATTTGAAATTGTCCA | 61 | 11837 | 11856 | 839 |
| 544224 | N/A | N/A | GGAAGCAACTCATATATTAA | 57 | 11869 | 11888 | 840 |
| 544225 | N/A | N/A | TATCAGAAAAGATACCTGA | 56 | 9821 | 9840 | 841 |
| 544226 | N/A | N/A | ATAATAGCTAATAATGTGGG | 59 | 9875 | 9894 | 842 |
| 544227 | N/A | N/A | TGCAGATAATAGCTAATAAT | 60 | 9880 | 9899 | 843 |
| 544228 | N/A | N/A | TGTCATTGCAGATAATAGCT | 79 | 9886 | 9905 | 844 |

TABLE 7-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544229 | N/A | N/A | TAAAAGTTGTCATTGCAGAT | 59 | 9893 | 9912 | 845 |
| 544230 | N/A | N/A | CGGATTTTTAAAAGTTGTCA | 61 | 9901 | 9920 | 846 |
| 544231 | N/A | N/A | GGGATTCGGATTTTTAAAAG | 28 | 9907 | 9926 | 847 |
| 544232 | N/A | N/A | TTTGGGATTCGGATTTTTAA | 44 | 9910 | 9929 | 848 |
| 544233 | N/A | N/A | ACGCTTATTTGGGATTCGGA | 72 | 9917 | 9936 | 849 |
| 544251 | N/A | N/A | TTTAAGAGATTTACAAGTCA | 52 | 2811 | 2830 | 850 |
| 544252 | N/A | N/A | GACTACCTGTTTTTAAAAGC | 48 | 2851 | 2870 | 851 |
| 544253 | N/A | N/A | TATGGTGACTACCTGTTTTT | 39 | 2857 | 2876 | 852 |
| 544254 | N/A | N/A | ACTTTGCTGTATTATAAACT | 35 | 2890 | 2909 | 853 |
| 544255 | N/A | N/A | ATTGTATTTAACTTTGCTGT | 35 | 2900 | 2919 | 854 |
| 544256 | N/A | N/A | GAGCAACTAACTTAATAGGT | 42 | 2928 | 2947 | 855 |
| 544257 | N/A | N/A | GAAATGAGCAACTAACTTAA | 32 | 2933 | 2952 | 856 |
| 544258 | N/A | N/A | AATCAAAGAAATGAGCAACT | 42 | 2940 | 2959 | 857 |
| 544259 | N/A | N/A | ACCTTCTTCCACATTGAGTT | 44 | 2977 | 2996 | 858 |
| 544260 | N/A | N/A | CACGAATGTAACCTTCTTCC | 52 | 2987 | 3006 | 859 |
| 544261 | N/A | N/A | TTAACTTGCACGAATGTAAC | 45 | 2995 | 3014 | 860 |
| 544262 | N/A | N/A | TATATATACCAATATTTGCC | 43 | 3063 | 3082 | 861 |
| 544263 | N/A | N/A | TCTTAACTCTATATATACCA | 49 | 3072 | 3091 | 862 |
| 544264 | N/A | N/A | CTTTAAGTGAAGTTACTTCT | 53 | 3632 | 3651 | 863 |
| 544265 | N/A | N/A | TCTACTTACTTTAAGTGAAG | 44 | 3640 | 3659 | 864 |
| 544266 | N/A | N/A | GAACCCTCTTTATTTTCTAC | 46 | 3655 | 3674 | 865 |
| 544267 | N/A | N/A | ACATAAACATGAACCCTCTT | 50 | 3665 | 3684 | 866 |
| 544268 | N/A | N/A | CCACATTGAAAACATAAACA | 57 | 3676 | 3695 | 867 |
| 544269 | N/A | N/A | GCATGCCTTAGAAATATTTT | 23 | 3707 | 3726 | 868 |
| 544270 | N/A | N/A | CAATGCAACAAAGTATTTCA | 37 | 3731 | 3750 | 869 |
| 544271 | N/A | N/A | CTGGAGATTATTTTCTTGG | 61 | 3768 | 3787 | 870 |
| 544272 | N/A | N/A | TTCATATATAACATTAGGGA | 14 | 3830 | 3849 | 871 |
| 544273 | N/A | N/A | TCAGTGTTTTCATATATAAC | 32 | 3838 | 3857 | 872 |
| 544274 | N/A | N/A | GACATAGTGTTCTAGATTGT | 47 | 3900 | 3919 | 873 |
| 544275 | N/A | N/A | CAATAGTGTAATGACATAGT | 39 | 3912 | 3931 | 874 |
| 544276 | N/A | N/A | TTACTTACCTTCAGTAATTT | 35 | 3933 | 3952 | 875 |
| 544277 | N/A | N/A | ATCTTTTCCATTTACTGTAT | 39 | 4005 | 4024 | 876 |
| 544278 | N/A | N/A | AGAAAAAGCCCAGCATATTT | 23 | 4037 | 4056 | 877 |
| 544279 | N/A | N/A | GTATGCTTCTTTCAAATAGC | 46 | 4130 | 4149 | 878 |
| 544280 | N/A | N/A | CCTTCCCCTTGTATGCTTCT | 47 | 4140 | 4159 | 879 |
| 544281 | N/A | N/A | CCTGTAACACTATCATAATC | 49 | 4207 | 4226 | 880 |

TABLE 7-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544282 | N/A | N/A | TGACTTACCTGATTTTCTAT | 24 | 4384 | 4403 | 881 |
| 544283 | N/A | N/A | GATGGGACATACCATTAAAA | 41 | 4407 | 4426 | 882 |
| 544284 | N/A | N/A | GTGAAAGATGGGACATACCA | 54 | 4413 | 4432 | 883 |
| 544285 | N/A | N/A | CCTGTGTGAAAGATGGGACA | 27 | 4418 | 4437 | 884 |
| 544286 | N/A | N/A | CATTGGCTGCTATGAATTAA | 45 | 4681 | 4700 | 885 |
| 544287 | N/A | N/A | GATGACATTGGCTGCTATGA | 49 | 4686 | 4705 | 886 |
| 544288 | N/A | N/A | GAGAAACATGATCTAATTTG | 33 | 4717 | 4736 | 887 |
| 544289 | N/A | N/A | ATGGAAAGCTATTGTGTGGT | 42 | 4747 | 4766 | 888 |
| 544290 | N/A | N/A | GTCTAAAGAGCCAATATGAG | 39 | 4771 | 4790 | 889 |
| 544291 | N/A | N/A | AATCTTGGTCTAAAGAGCCA | 65 | 4778 | 4797 | 890 |
| 544361 | N/A | N/A | GGAGCTTGAGATTTCACTTG | 66 | 7284 | 7303 | 891 |
| 544362 | N/A | N/A | CATCAGATTTAGTAATAGGA | 61 | 7315 | 7334 | 892 |
| 544363 | N/A | N/A | GTTATTACATCAGATTTAGT | 63 | 7322 | 7341 | 893 |
| 544365 | N/A | N/A | CAGCAGGAATGCCTAGAATC | 72 | 7350 | 7369 | 894 |
| 544366 | N/A | N/A | CTCCTTAGACAGGTTTTACC | 67 | 7471 | 7490 | 895 |
| 544367 | N/A | N/A | GTCTATTCTCCTTAGACAGG | 59 | 7478 | 7497 | 896 |
| 544368 | N/A | N/A | ACCAGGTTAATCTTCCTAAT | 79 | 7526 | 7545 | 22 |
| 544369 | N/A | N/A | ATGAATGATTGAATGTAGTC | 56 | 7977 | 7996 | 897 |
| 544370 | N/A | N/A | ATATGAAGGCTGAGACTGCT | 73 | 8072 | 8091 | 898 |
| 544371 | N/A | N/A | ATAAATTATATGAAGGCTGA | 51 | 8079 | 8098 | 899 |
| 544372 | N/A | N/A | ATATTTAAGAACAGACATGT | 54 | 8175 | 8194 | 900 |
| 544373 | N/A | N/A | AGTTATGATCATTGTAAGCC | 77 | 8217 | 8236 | 23 |
| 544374 | N/A | N/A | ATTTGTAACAGTTACTACTT | 69 | 8276 | 8295 | 901 |
| 544375 | N/A | N/A | CACAGCTTATTTGTAACAGT | 72 | 8284 | 8303 | 902 |
| 544376 | N/A | N/A | GGAGTGGTTCTTTTCACAGC | 82 | 8298 | 8317 | 24 |
| 544377 | N/A | N/A | GTGACTAATGCTAGGAGTGG | 54 | 8311 | 8330 | 903 |
| 544378 | N/A | N/A | GAATAGAGTGACTAATGCTA | 55 | 8318 | 8337 | 904 |
| 544379 | N/A | N/A | ATGAGAGAATAGAGTGACTA | 66 | 8324 | 8343 | 905 |
| 544380 | N/A | N/A | TGGTCCTTTTAACTTCCAAT | 79 | 8365 | 8384 | 25 |
| 544381 | N/A | N/A | TATACTGTATGTCTGAGTTT | 72 | 8387 | 8406 | 906 |
| 544382 | N/A | N/A | AACTAATTCATTATAAGCCA | 56 | 8450 | 8469 | 907 |
| 544383 | N/A | N/A | GCATTGAGTTAACTAATTCA | 78 | 8460 | 8479 | 26 |
| 544385 | N/A | N/A | TTTGGATTTAAACATCTGT | 73 | 8528 | 8547 | 908 |
| 544386 | N/A | N/A | TGTATGTGCTTTTTGGATTT | 57 | 8539 | 8558 | 909 |
| 544387 | N/A | N/A | CATGGATTTTTGTATGTGCT | 64 | 8549 | 8568 | 910 |
| 544388 | N/A | N/A | TCATTCATGGATTTTTGTAT | 53 | 8554 | 8573 | 911 |

TABLE 7-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544389 | N/A | N/A | ACTTAGACATCATTCATGGA | 66 | 8563 | 8582 | 912 |
| 544390 | N/A | N/A | GTGAGTACTTAGACATCATT | 74 | 8569 | 8588 | 913 |
| 544391 | N/A | N/A | TTTATAAGTGAGTACTTAGA | 32 | 8576 | 8595 | 914 |
| 544392 | N/A | N/A | GTCTTCTACTTTATAAGTGA | 63 | 8585 | 8604 | 915 |
| 544393 | N/A | N/A | ATGAATGTCTTCTACTTTAT | 68 | 8591 | 8610 | 916 |
| 544394 | N/A | N/A | CAAATAGTACTGAGCATTTA | 53 | 8627 | 8646 | 917 |
| 544395 | N/A | N/A | TTAGAAGATTTGGAGCTACA | 55 | 8718 | 8737 | 918 |
| 544396 | N/A | N/A | TCACTATTAGAAGATTTGGA | 60 | 8724 | 8743 | 919 |
| 544397 | N/A | N/A | GGGTTACACTCACTATTAGA | 52 | 8733 | 8752 | 920 |
| 544398 | N/A | N/A | ACTTACCTGTCAGCCTTTTA | 61 | 8758 | 8777 | 921 |
| 544399 | N/A | N/A | CTTACCAGAATTAAGTGAGT | 43 | 8785 | 8804 | 922 |
| 544400 | N/A | N/A | AATACAAGTACAAATGGGTT | 29 | 8810 | 8829 | 923 |
| 544401 | N/A | N/A | CTGGTAAATACAAGTACAAA | 76 | 8816 | 8835 | 924 |
| 544402 | N/A | N/A | GGATTGCTGGTAAATACAAG | 59 | 8822 | 8841 | 925 |
| 544403 | N/A | N/A | TCATTTTAAGGATTGCTGGT | 63 | 8831 | 8850 | 926 |
| 544404 | N/A | N/A | AGTTAGTAGGAAGCTTCATT | 54 | 8846 | 8865 | 927 |
| 544405 | N/A | N/A | GCTATTGAGTTAGTAGGAAG | 63 | 8853 | 8872 | 928 |
| 544407 | N/A | N/A | AGCATGGTTCTTAATAACTT | 69 | 9012 | 9031 | 929 |
| 544408 | N/A | N/A | CTTTGTAGAAAAAGACAGGA | 45 | 9062 | 9081 | 930 |
| 544409 | N/A | N/A | ACCTGGCCTTTGGTATTTGC | 66 | 9096 | 9115 | 931 |
| 544410 | N/A | N/A | CATCCATATACAGTCAAGAG | 78 | 9174 | 9193 | 27 |
| 544411 | N/A | N/A | AGTCTTTATATGGATAAACT | 46 | 9215 | 9234 | 932 |
| 544412 | N/A | N/A | CGTCATTGGTAGAGGAATAT | 45 | 9240 | 9259 | 933 |
| 544413 | N/A | N/A | GATTATCCTTTCTATAATGC | 45 | 9321 | 9340 | 934 |
| 544414 | N/A | N/A | GTCTTGAATCCCTTGATCAT | 61 | 9436 | 9455 | 935 |
| 544415 | N/A | N/A | GGTGCAACTAATTGAGTTGT | 49 | 9459 | 9478 | 936 |
| 544416 | N/A | N/A | GTGTTTTTATTGGTGCAAC | 46 | 9471 | 9490 | 937 |
| 544417 | N/A | N/A | ATTCTCCTGAAAAGAAAAGT | 50 | 9544 | 9563 | 938 |
| 544418 | N/A | N/A | ATGCCACCACCAGCCTCCTA | 73 | 10219 | 10238 | 939 |
| 544419 | N/A | N/A | ATATCCTTTAACAAATGGGT | 68 | 11540 | 11559 | 940 |
| 544420 | N/A | N/A | GCACTATATCCTTTAACAAA | 74 | 11545 | 11564 | 941 |
| 544421 | N/A | N/A | ACTTGGGCACTATATCCTTT | 68 | 11551 | 11570 | 942 |
| 544422 | N/A | N/A | GAAACATGTCCTATGAGAGT | 56 | 11918 | 11937 | 943 |
| 544424 | N/A | N/A | TTGAGCACTTTAAGCAAAGT | 15 | 12070 | 12089 | 944 |
| 544425 | N/A | N/A | GGAATTTGAGCACTTTAAGC | 35 | 12075 | 12094 | 945 |
| 544426 | N/A | N/A | TAGATTAGACAACTGTGAGT | 54 | 12101 | 12120 | 946 |

TABLE 7-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544427 | N/A | N/A | AAAATGAAGGTCAAGTTTGA | 45 | 12197 | 12216 | 947 |
| 544428 | N/A | N/A | GTGAAAGCAAAATGAAGGTC | 55 | 12205 | 12224 | 948 |
| 544429 | N/A | N/A | GTATTGTGAAAGCAAAATGA | 54 | 12210 | 12229 | 949 |
| 544430 | N/A | N/A | TGGAGAGTATAGTATTGTGA | 53 | 12221 | 12240 | 950 |
| 544433 | N/A | N/A | GAGATTTACAAGTCAAAAAT | 41 | 2806 | 2825 | 951 |
| 544434 | N/A | N/A | ATTTAACTTTGCTGTATTAT | 29 | 2895 | 2914 | 952 |
| 544435 | N/A | N/A | ATCAATGCTAAATGAAATCA | 34 | 2955 | 2974 | 953 |
| 544436 | N/A | N/A | TATTTTCTGGAGATTATTTT | 24 | 3774 | 3793 | 954 |
| 544437 | N/A | N/A | AAAATGAATATTGGCAATTC | 34 | 4159 | 4178 | 955 |
| 544446 | N/A | N/A | AATGCCTAGAATCAATAAAA | 50 | 7343 | 7362 | 956 |
| 544447 | N/A | N/A | GTAAATATTTGTAGATTAGC | 38 | 8003 | 8022 | 957 |
| 544448 | N/A | N/A | ACAAATGTGTAATTGTTTGA | 43 | 8101 | 8120 | 958 |
| 544449 | N/A | N/A | TACTAACAAATGTGTAATTG | 59 | 8106 | 8125 | 959 |
| 544450 | N/A | N/A | TGATAAGTATATTTAAGAAC | 45 | 8183 | 8202 | 960 |
| 544451 | N/A | N/A | TTAACTTCCAATTAATTGAT | 55 | 8357 | 8376 | 961 |
| 544452 | N/A | N/A | TCTGTTATTTTATCTTGCTT | 67 | 8513 | 8532 | 962 |
| 544453 | N/A | N/A | ATCACAATCCTTTTTATTAA | 39 | 8921 | 8940 | 963 |
| 544454 | N/A | N/A | AGAGACTTGAGTAATAATAA | 43 | 9137 | 9156 | 964 |
| 544455 | N/A | N/A | AACAAAATGAAACATGTCCT | 47 | 11926 | 11945 | 965 |
| 544059 | 23 | 42 | GATTTTCAATTTCAAGCAAC | 74 | 3127 | 3146 | 966 |
| 337459 | 49 | 68 | AGCTTAATTGTGAACATTTT | 77 | 3153 | 3172 | 967 |
| 544060 | 54 | 73 | GAAGGAGCTTAATTGTGAAC | 59 | 3158 | 3177 | 968 |
| 544061 | 63 | 82 | CAATAAAAGAAGGAGCTTA | 64 | 3167 | 3186 | 969 |
| 544062 | 66 | 85 | GAACAATAAAAGAAGGAGC | 67 | 3170 | 3189 | 970 |
| 544063 | 85 | 104 | CTGGAGGAAATAACTAGAGG | 49 | 3189 | 3208 | 971 |
| 337460 | 88 | 107 | ATTCTGGAGGAAATAACTAG | 65 | 3192 | 3211 | 972 |
| 544064 | 112 | 131 | TCAAATGATGAATTGTCTTG | 58 | 3216 | 3235 | 973 |
| 544065 | 138 | 157 | TTGATTTTGGCTCTGGAGAT | 67 | 3242 | 3261 | 974 |
| 544066 | 145 | 164 | GCAAATCTTGATTTTGGCTC | 82 | 3249 | 3268 | 975 |
| 233676 | 148 | 167 | ATAGCAAATCTTGATTTTGG | 81 | 3252 | 3271 | 976 |
| 544067 | 156 | 175 | CGTCTAACATAGCAAATCTT | 87 | 3260 | 3279 | 977 |
| 544068 | 174 | 193 | TGGCTAAAATTTTACATCG | 66 | 3278 | 3297 | 978 |
| 544069 | 178 | 197 | CCATTGGCTAAAATTTTTAC | 41 | 3282 | 3301 | 979 |
| 544070 | 184 | 203 | AGGAGGCCATTGGCTAAAAT | 36 | 3288 | 3307 | 980 |
| 544071 | 187 | 206 | TGAAGGAGGCCATTGGCTAA | 44 | 3291 | 3310 | 981 |
| 544072 | 195 | 214 | GTCCCAACTGAAGGAGGCCA | 59 | 3299 | 3318 | 982 |

TABLE 7-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544073 | 199 | 218 | CCATGTCCCAACTGAAGGAG | 54 | 3303 | 3322 | 983 |
| 544074 | 202 | 221 | AGACCATGTCCCAACTGAAG | 68 | 3306 | 3325 | 984 |
| 544075 | 206 | 225 | TTTAAGACCATGTCCCAACT | 51 | 3310 | 3329 | 985 |
| 544076 | 209 | 228 | GTCTTTAAGACCATGTCCCA | 64 | 3313 | 3332 | 986 |
| 544077 | 216 | 235 | GGACAAAGTCTTTAAGACCA | 45 | 3320 | 3339 | 987 |
| 544078 | 222 | 241 | TCTTATGGACAAAGTCTTTA | 40 | 3326 | 3345 | 988 |
| 544079 | 245 | 264 | TATGTCATTAATTTGGCCCT | 30 | 3349 | 3368 | 989 |
| 544080 | 270 | 289 | GATCAAATATGTTGAGTTTT | 65 | 3374 | 3393 | 990 |
| 233690 | 274 | 293 | GACTGATCAAATATGTTGAG | 75 | 3378 | 3397 | 991 |
| 544081 | 316 | 335 | TCTTCTTTGATTTCACTGGT | 86 | 3420 | 3439 | 992 |
| 544082 | 334 | 353 | CTTCTCAGTTCCTTTTCTTC | 69 | 3438 | 3457 | 993 |
| 544083 | 337 | 356 | GTTCTTCTCAGTTCCTTTTC | 77 | 3441 | 3460 | 994 |
| 544084 | 341 | 360 | TGTAGTTCTTCTCAGTTCCT | 75 | 3445 | 3464 | 995 |
| 544431 | 345 | 364 | TATATGTAGTTCTTCTCAGT | 15 | 3449 | 3468 | 996 |
| 544086 | 348 | 367 | GTTTATATGTAGTTCTTCTC | 65 | 3452 | 3471 | 997 |
| 544087 | 352 | 371 | TGTAGTTTATATGTAGTTCT | 49 | 3456 | 3475 | 998 |
| 544088 | 356 | 375 | GACTTGTAGTTTATATGTAG | 21 | 3460 | 3479 | 999 |
| 544089 | 364 | 383 | TCATTTTTGACTTGTAGTTT | 60 | 3468 | 3487 | 1000 |
| 544090 | 369 | 388 | CCTCTTCATTTTTGACTTGT | 83 | 3473 | 3492 | 1001 |
| 544091 | 375 | 394 | TCTTTACCTCTTCATTTTTG | 75 | 3479 | 3498 | 1002 |
| 544092 | 380 | 399 | CATATTCTTTACCTCTTCAT | 77 | 3484 | 3503 | 1003 |
| 544093 | 384 | 403 | GTGACATATTCTTTACCTCT | 76 | 3488 | 3507 | 1004 |
| 544094 | 392 | 411 | GAGTTCAAGTGACATATTCT | 71 | 3496 | 3515 | 1005 |
| 544095 | 398 | 417 | TGAGTTGAGTTCAAGTGACA | 44 | 3502 | 3521 | 1006 |
| 544096 | 403 | 422 | AGTTTTGAGTTGAGTTCAAG | 33 | 3507 | 3526 | 1007 |
| 544097 | 406 | 425 | TCAAGTTTTGAGTTGAGTTC | 69 | 3510 | 3529 | 1008 |
| 544098 | 414 | 433 | GGAGGCTTTCAAGTTTTGAG | 68 | 3518 | 3537 | 1009 |
| 544099 | 423 | 442 | TTTCTTCTAGGAGGCTTTCA | 79 | 3527 | 3546 | 1010 |
| 544100 | 427 | 446 | ATTTTTTCTTCTAGGAGGCT | 63 | 3531 | 3550 | 1011 |
| 544101 | 432 | 451 | GTAGAATTTTTTCTTCTAGG | 56 | 3536 | 3555 | 1012 |
| 544102 | 462 | 481 | GCTCTTCTAAATATTTCACT | 85 | 3566 | 3585 | 1013 |
| 544103 | 474 | 493 | AGTTAGTTAGTTGCTCTTCT | 71 | 3578 | 3597 | 1014 |
| 544104 | 492 | 511 | CAGGTTGATTTTGAATTAAG | 69 | 3596 | 3615 | 1015 |
| 544105 | 495 | 514 | TTTCAGGTTGATTTTGAATT | 53 | 3599 | 3618 | 1016 |
| 544106 | 499 | 518 | GGAGTTTCAGGTTGATTTTG | 64 | 3603 | 3622 | 1017 |
| 544107 | 504 | 523 | GTTCTGGAGTTTCAGGTTGA | 74 | 3608 | 3627 | 1018 |

TABLE 7-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544108 | 526 | 545 | TTAAGTGAAGTTACTTCTGG | 60 | 3630 | 3649 | 1019 |
| 544109 | 555 | 574 | TGCTATTATCTTGTTTTTCT | 63 | 4293 | 4312 | 1020 |
| 544110 | 564 | 583 | GGTCTTTGATGCTATTATCT | 65 | 4302 | 4321 | 1021 |
| 544111 | 567 | 586 | GAAGGTCTTTGATGCTATTA | 49 | 4305 | 4324 | 1022 |
| 544112 | 572 | 591 | CTGGAGAAGGTCTTTGATGC | 65 | 4310 | 4329 | 1023 |
| 544113 | 643 | 662 | CTGAGCTGATTTTCTATTTC | 64 | N/A | N/A | 1024 |
| 337477 | 664 | 683 | GGTTCTTGAATACTAGTCCT | 82 | 6677 | 6696 | 234 |
| 544114 | 673 | 692 | ATTTCTGTGGGTTCTTGAAT | 57 | 6686 | 6705 | 1025 |
| 337478 | 675 | 694 | AAATTTCTGTGGGTTCTTGA | 29 | 6688 | 6707 | 235 |
| 544115 | 678 | 697 | GAGAAATTTCTGTGGGTTCT | 68 | 6691 | 6710 | 1026 |
| 544116 | 682 | 701 | GATAGAGAAATTTCTGTGGG | 54 | 6695 | 6714 | 1027 |
| 544117 | 689 | 708 | CTTGGAAGATAGAGAAATTT | 36 | 6702 | 6721 | 1028 |
| 337479 | 692 | 711 | TGGCTTGGAAGATAGAGAAA | 54 | 6705 | 6724 | 236 |
| 544118 | 699 | 718 | GTGCTCTTGGCTTGGAAGAT | 64 | 6712 | 6731 | 1029 |
| 544119 | 703 | 722 | CTTGGTGCTCTTGGCTTGGA | 68 | 6716 | 6735 | 1030 |
| 544120 | 707 | 726 | AGTTCTTGGTGCTCTTGGCT | 91 | 6720 | 6739 | 15 |
| 233710 | 710 | 729 | AGTAGTTCTTGGTGCTCTTG | 80 | 6723 | 6742 | 233 |
| 544121 | 713 | 732 | GGGAGTAGTTCTTGGTGCTC | 76 | 6726 | 6745 | 1031 |
| 544122 | 722 | 741 | CTGAAGAAAGGGAGTAGTTC | 55 | 6735 | 6754 | 1032 |
| 544123 | 752 | 771 | ATCATGTTTTACATTTCTTA | 52 | 6765 | 6784 | 1033 |
| 544124 | 755 | 774 | GCCATCATGTTTTACATTTC | 61 | N/A | N/A | 1034 |
| 544125 | 759 | 778 | GAATGCCATCATGTTTTACA | 30 | N/A | N/A | 1035 |
| 544126 | 762 | 781 | CAGGAATGCCATCATGTTTT | 34 | N/A | N/A | 1036 |
| 337487 | 804 | 823 | CACTTGTATGTTCACCTCTG | 83 | 7389 | 7408 | 28 |
| 233717 | 889 | 908 | TGAATTAATGTCCATGGACT | 75 | 7876 | 7895 | 14 |
| 544202 | 2081 | 2100 | AAAGTCAATGTGACTTAGTA | 70 | 11053 | 11072 | 1037 |
| 544203 | 2104 | 2123 | AAGGTATAGTGATACCTCAT | 84 | 11076 | 11095 | 1038 |

TABLE 8

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560535 | N/A | N/A | ACTGTTTTCTTCTGGAAGCA | 0 | 3102 | 3121 | 1039 |
| 560536 | N/A | N/A | AAATAAGGTATAGTGATACC | 0 | 11080 | 11099 | 1040 |

TABLE 8-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560537 | N/A | N/A | ACAAATAAGGTATAGTGATA | 1 | 11082 | 11101 | 1041 |
| 560538 | N/A | N/A | TAACAAATAAGGTATAGTGA | 0 | 11084 | 11103 | 1042 |
| 560539 | N/A | N/A | TTTAACAAATAAGGTATAGT | 16 | 11086 | 11105 | 1043 |
| 560540 | N/A | N/A | ATATATTTTAACAAATAAGG | 0 | 11092 | 11111 | 1044 |
| 560541 | N/A | N/A | CAGTATATATTTTAACAAAT | 0 | 11096 | 11115 | 1045 |
| 560542 | N/A | N/A | TACAGTATATATTTTAACAA | 0 | 11098 | 11117 | 1046 |
| 560543 | N/A | N/A | TATACAGTATATATTTTAAC | 0 | 11100 | 11119 | 1047 |
| 560544 | N/A | N/A | ATAGTATTAAGTGTTAAAAT | 0 | 11130 | 11149 | 1048 |
| 560545 | N/A | N/A | TCATAGTATTAAGTGTTAAA | 0 | 11132 | 11151 | 1049 |
| 560546 | N/A | N/A | GTTTTCATAGTATTAAGTGT | 26 | 11136 | 11155 | 1050 |
| 560547 | N/A | N/A | ATTATTTGTTTTCATAGTAT | 0 | 11143 | 11162 | 1051 |
| 560548 | N/A | N/A | CTTTACAATTATTTGTTTTC | 0 | 11150 | 11169 | 1052 |
| 560549 | N/A | N/A | ATTCCTTTACAATTATTTGT | 21 | 11154 | 11173 | 1053 |
| 560550 | N/A | N/A | AGATTCCTTTACAATTATTT | 18 | 11156 | 11175 | 1054 |
| 560551 | N/A | N/A | CAAGATTCCTTTACAATTAT | 21 | 11158 | 11177 | 1055 |
| 560552 | N/A | N/A | GACAAGATTCCTTTACAATT | 55 | 11160 | 11179 | 1056 |
| 560553 | N/A | N/A | CTGACAAGATTCCTTTACAA | 47 | 11162 | 11181 | 1057 |
| 560554 | N/A | N/A | AATCTGACAAGATTCCTTTA | 52 | 11165 | 11184 | 1058 |
| 560555 | N/A | N/A | GTAATCTGACAAGATTCCTT | 56 | 11167 | 11186 | 1059 |
| 560556 | N/A | N/A | CTGTAATCTGACAAGATTCC | 51 | 11169 | 11188 | 1060 |
| 560557 | N/A | N/A | TACTGTAATCTGACAAGATT | 18 | 11171 | 11190 | 1061 |
| 560558 | N/A | N/A | CTTACTGTAATCTGACAAGA | 33 | 11173 | 11192 | 1062 |
| 560559 | N/A | N/A | TTCTTACTGTAATCTGACAA | 47 | 11175 | 11194 | 1063 |
| 560560 | N/A | N/A | CATTCTTACTGTAATCTGAC | 65 | 11177 | 11196 | 1064 |
| 560561 | N/A | N/A | TTCATTCTTACTGTAATCTG | 54 | 11179 | 11198 | 1065 |
| 560562 | N/A | N/A | TGTTCATTCTTACTGTAATC | 44 | 11181 | 11200 | 1066 |
| 560563 | N/A | N/A | TATGTTCATTCTTACTGTAA | 39 | 11183 | 11202 | 1067 |
| 560564 | N/A | N/A | AATATGTTCATTCTTACTGT | 0 | 11185 | 11204 | 1068 |
| 560565 | N/A | N/A | ACAAATATGTTCATTCTTAC | 3 | 11188 | 11207 | 1069 |
| 560566 | N/A | N/A | CCACAAATATGTTCATTCTT | 75 | 11190 | 11209 | 42 |
| 560567 | N/A | N/A | TGCCACAAATATGTTCATTC | 80 | 11192 | 11211 | 43 |
| 560568 | N/A | N/A | CGATGCCACAAATATGTTCA | 64 | 11195 | 11214 | 1070 |
| 560569 | N/A | N/A | CTCGATGCCACAAATATGTT | 65 | 11197 | 11216 | 1071 |
| 560570 | N/A | N/A | AACTCGATGCCACAAATATG | 46 | 11199 | 11218 | 1072 |
| 560571 | N/A | N/A | TTAACTCGATGCCACAAATA | 52 | 11201 | 11220 | 1073 |

TABLE 8-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560572 | N/A | N/A | CTTTAACTCGATGCCACAAA | 66 | 11203 | 11222 | 1074 |
| 560573 | N/A | N/A | AACTTTAACTCGATGCCACA | 53 | 11205 | 11224 | 1075 |
| 560574 | N/A | N/A | TAAACTTTAACTCGATGCCA | 72 | 11207 | 11226 | 44 |
| 560575 | N/A | N/A | AATATAAACTTTAACTCGAT | 6 | 11211 | 11230 | 1076 |
| 560576 | N/A | N/A | GAAATATAAACTTTAACTCG | 17 | 11213 | 11232 | 1077 |
| 560577 | N/A | N/A | GGGAAATATAAACTTTAACT | 0 | 11215 | 11234 | 1078 |
| 560578 | N/A | N/A | GAATCACAGCATATTTAGGG | 46 | 11233 | 11252 | 1079 |
| 560579 | N/A | N/A | TAGAATCACAGCATATTTAG | 32 | 11235 | 11254 | 1080 |
| 560580 | N/A | N/A | GTATTAGAATCACAGCATAT | 51 | 11239 | 11258 | 1081 |
| 560581 | N/A | N/A | ATGTATTAGAATCACAGCAT | 64 | 11241 | 11260 | 1082 |
| 560582 | N/A | N/A | GAATGTATTAGAATCACAGC | 44 | 11243 | 11262 | 1083 |
| 560583 | N/A | N/A | ACGAATGTATTAGAATCACA | 44 | 11245 | 11264 | 1084 |
| 560584 | N/A | N/A | ACACGAATGTATTAGAATCA | 41 | 11247 | 11266 | 1085 |
| 560585 | N/A | N/A | CTACACGAATGTATTAGAAT | 15 | 11249 | 11268 | 1086 |
| 560586 | N/A | N/A | ACCTACACGAATGTATTAGA | 37 | 11251 | 11270 | 1087 |
| 560587 | N/A | N/A | AAACCTACACGAATGTATTA | 3 | 11253 | 11272 | 1088 |
| 560588 | N/A | N/A | GAAACCTACACGAATGTAT | 27 | 11255 | 11274 | 1089 |
| 560589 | N/A | N/A | TTGAAAACCTACACGAATGT | 19 | 11257 | 11276 | 1090 |
| 560590 | N/A | N/A | ACTTGAAAACCTACACGAAT | 21 | 11259 | 11278 | 1091 |
| 560591 | N/A | N/A | CTACTTGAAAACCTACACGA | 43 | 11261 | 11280 | 1092 |
| 560592 | N/A | N/A | TATTTCTACTTGAAAACCTA | 29 | 11266 | 11285 | 1093 |
| 560593 | N/A | N/A | TTTATTTCTACTTGAAAACC | 2 | 11268 | 11287 | 1094 |
| 560594 | N/A | N/A | GGTTTATTTCTACTTGAAAA | 27 | 11270 | 11289 | 1095 |
| 560595 | N/A | N/A | GAGGTTTATTTCTACTTGAA | 45 | 11272 | 11291 | 1096 |
| 560596 | N/A | N/A | ACGAGGTTTATTTCTACTTG | 75 | 11274 | 11293 | 45 |
| 560597 | N/A | N/A | TTACGAGGTTTATTTCTACT | 49 | 11276 | 11295 | 1097 |
| 560598 | N/A | N/A | TGTTACGAGGTTTATTTCTA | 39 | 11278 | 11297 | 1098 |
| 560599 | N/A | N/A | CTTGTTACGAGGTTTATTTC | 32 | 11280 | 11299 | 1099 |
| 560600 | N/A | N/A | AACTTGTTACGAGGTTTATT | 27 | 11282 | 11301 | 1100 |
| 560601 | N/A | N/A | GTAACTTGTTACGAGGTTTA | 55 | 11284 | 11303 | 1101 |
| 560602 | N/A | N/A | CAGTAACTTGTTACGAGGTT | 51 | 11286 | 11305 | 1102 |
| 560603 | N/A | N/A | TTCAGTAACTTGTTACGAGG | 40 | 11288 | 11307 | 1103 |
| 560604 | N/A | N/A | CGTTCAGTAACTTGTTACGA | 53 | 11290 | 11309 | 1104 |
| 560605 | N/A | N/A | CTTGTCAGGCTGTTTAAACG | 24 | 11308 | 11327 | 1105 |
| 560606 | N/A | N/A | TGCTTGTCAGGCTGTTTAAA | 46 | 11310 | 11329 | 1106 |
| 560607 | N/A | N/A | CATGCTTGTCAGGCTGTTTA | 72 | 11312 | 11331 | 46 |

TABLE 8-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560608 | N/A | N/A | TACATGCTTGTCAGGCTGTT | 72 | 11314 | 11333 | 47 |
| 560609 | N/A | N/A | TATACATGCTTGTCAGGCTG | 63 | 11316 | 11335 | 1107 |
| 560610 | N/A | N/A | TATATACATGCTTGTCAGGC | 55 | 11318 | 11337 | 1108 |
| 560611 | N/A | N/A | CATATATACATGCTTGTCAG | 47 | 11320 | 11339 | 1109 |
| 560235 | 2 | 21 | TGGAACTGTTTTCTTCTGGA | 43 | 3106 | 3125 | 1110 |
| 337526 | 4 | 23 | CGTGGAACTGTTTTCTTCTG | 54 | 3108 | 3127 | 1111 |
| 560236 | 25 | 44 | TTGATTTTCAATTTCAAGCA | 91 | 3129 | 3148 | 30 |
| 560237 | 27 | 46 | TCTTGATTTTCAATTTCAAG | 33 | 3131 | 3150 | 1112 |
| 560238 | 32 | 51 | TTTTATCTTGATTTTCAATT | 0 | 3136 | 3155 | 1113 |
| 560239 | 35 | 54 | CATTTTTATCTTGATTTTCA | 6 | 3139 | 3158 | 1114 |
| 560240 | 43 | 62 | ATTGTGAACATTTTTATCTT | 0 | 3147 | 3166 | 1115 |
| 560241 | 45 | 64 | TAATTGTGAACATTTTTATC | 20 | 3149 | 3168 | 1116 |
| 560242 | 56 | 75 | AAGAAGGAGCTTAATTGTGA | 39 | 3160 | 3179 | 1117 |
| 560243 | 58 | 77 | AAAAGAAGGAGCTTAATTGT | 17 | 3162 | 3181 | 1118 |
| 560244 | 60 | 79 | TAAAAGAAGGAGCTTAATT | 0 | 3164 | 3183 | 1119 |
| 560245 | 75 | 94 | TAACTAGAGGAACAATAAAA | 37 | 3179 | 3198 | 1120 |
| 560246 | 77 | 96 | AATAACTAGAGGAACAATAA | 3 | 3181 | 3200 | 1121 |
| 560247 | 79 | 98 | GAAATAACTAGAGGAACAAT | 13 | 3183 | 3202 | 1122 |
| 560248 | 81 | 100 | AGGAAATAACTAGAGGAACA | 28 | 3185 | 3204 | 1123 |
| 560249 | 83 | 102 | GGAGGAAATAACTAGAGGAA | 12 | 3187 | 3206 | 1124 |
| 560250 | 90 | 109 | CAATTCTGGAGGAAATAACT | 34 | 3194 | 3213 | 1125 |
| 560251 | 92 | 111 | ATCAATTCTGGAGGAAATAA | 32 | 3196 | 3215 | 1126 |
| 560252 | 96 | 115 | CTTGATCAATTCTGGAGGAA | 15 | 3200 | 3219 | 1127 |
| 560253 | 98 | 117 | GTCTTGATCAATTCTGGAGG | 53 | 3202 | 3221 | 1128 |
| 560254 | 100 | 119 | TTGTCTTGATCAATTCTGGA | 48 | 3204 | 3223 | 1129 |
| 560255 | 102 | 121 | AATTGTCTTGATCAATTCTG | 23 | 3206 | 3225 | 1130 |
| 560256 | 104 | 123 | TGAATTGTCTTGATCAATTC | 14 | 3208 | 3227 | 1131 |
| 560257 | 106 | 125 | GATGAATTGTCTTGATCAAT | 46 | 3210 | 3229 | 1132 |
| 560258 | 108 | 127 | ATGATGAATTGTCTTGATCA | 33 | 3212 | 3231 | 1133 |
| 560259 | 110 | 129 | AAATGATGAATTGTCTTGAT | 24 | 3214 | 3233 | 1134 |
| 560260 | 114 | 133 | AATCAAATGATGAATTGTCT | 25 | 3218 | 3237 | 1135 |
| 560261 | 116 | 135 | AGAATCAAATGATGAATTGT | 16 | 3220 | 3239 | 1136 |
| 560262 | 119 | 138 | TAGAGAATCAAATGATGAAT | 7 | 3223 | 3242 | 1137 |
| 560263 | 126 | 145 | CTGGAGATAGAGAATCAAAT | 40 | 3230 | 3249 | 1138 |
| 560264 | 128 | 147 | CTCTGGAGATAGAGAATCAA | 51 | 3232 | 3251 | 1139 |

TABLE 8-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560265 | 130 | 149 | GGCTCTGGAGATAGAGAATC | 63 | 3234 | 3253 | 31 |
| 560266 | 132 | 151 | TTGGCTCTGGAGATAGAGAA | 49 | 3236 | 3255 | 1140 |
| 560267 | 135 | 154 | ATTTTGGCTCTGGAGATAGA | 49 | 3239 | 3258 | 1141 |
| 560268 | 140 | 159 | TCTTGATTTTGGCTCTGGAG | 69 | 3244 | 3263 | 32 |
| 560269 | 142 | 161 | AATCTTGATTTTGGCTCTGG | 53 | 3246 | 3265 | 1142 |
| 560270 | 150 | 169 | ACATAGCAAATCTTGATTTT | 25 | 3254 | 3273 | 1143 |
| 560271 | 152 | 171 | TAACATAGCAAATCTTGATT | 0 | 3256 | 3275 | 1144 |
| 560272 | 154 | 173 | TCTAACATAGCAAATCTTGA | 53 | 3258 | 3277 | 1145 |
| 560273 | 176 | 195 | ATTGGCTAAAATTTTTACAT | 12 | 3280 | 3299 | 1146 |
| 560274 | 180 | 199 | GGCCATTGGCTAAAATTTTT | 34 | 3284 | 3303 | 1147 |
| 560275 | 182 | 201 | GAGGCCATTGGCTAAAATTT | 26 | 3286 | 3305 | 1148 |
| 560276 | 189 | 208 | ACTGAAGGAGGCCATTGGCT | 51 | 3293 | 3312 | 1149 |
| 560277 | 191 | 210 | CAACTGAAGGAGGCCATTGG | 28 | 3295 | 3314 | 1150 |
| 560278 | 193 | 212 | CCCAACTGAAGGAGGCCATT | 10 | 3297 | 3316 | 1151 |
| 560279 | 197 | 216 | ATGTCCCAACTGAAGGAGGC | 0 | 3301 | 3320 | 1152 |
| 560280 | 204 | 223 | TAAGACCATGTCCCAACTGA | 13 | 3308 | 3327 | 1153 |
| 560281 | 211 | 230 | AAGTCTTTAAGACCATGTCC | 4 | 3315 | 3334 | 1154 |
| 560282 | 213 | 232 | CAAAGTCTTTAAGACCATGT | 24 | 3317 | 3336 | 1155 |
| 560283 | 219 | 238 | TATGGACAAAGTCTTTAAGA | 8 | 3323 | 3342 | 1156 |
| 560284 | 224 | 243 | CGTCTTATGGACAAAGTCTT | 11 | 3328 | 3347 | 1157 |
| 560285 | 242 | 261 | GTCATTAATTTGGCCCTTCG | 57 | 3346 | 3365 | 33 |
| 560286 | 247 | 266 | AATATGTCATTAATTTGGCC | 0 | 3351 | 3370 | 1158 |
| 560287 | 249 | 268 | GAAATATGTCATTAATTTGG | 0 | 3353 | 3372 | 1159 |
| 560288 | 252 | 271 | TTTGAAATATGTCATTAATT | 4 | 3356 | 3375 | 1160 |
| 560289 | 256 | 275 | AGTTTTTGAAATATGTCATT | 7 | 3360 | 3379 | 1161 |
| 560290 | 258 | 277 | TGAGTTTTTGAAATATGTCA | 41 | 3362 | 3381 | 1162 |
| 560291 | 267 | 286 | CAAATATGTTGAGTTTTTGA | 30 | 3371 | 3390 | 1163 |
| 560292 | 272 | 291 | CTGATCAAATATGTTGAGTT | 32 | 3376 | 3395 | 1164 |
| 560293 | 276 | 295 | AAGACTGATCAAATATGTTG | 37 | 3380 | 3399 | 1165 |
| 560294 | 280 | 299 | TAAAAAGACTGATCAAATAT | 0 | 3384 | 3403 | 1166 |
| 560295 | 282 | 301 | CATAAAAAGACTGATCAAAT | 6 | 3386 | 3405 | 1167 |
| 560296 | 284 | 303 | ATCATAAAAAGACTGATCAA | 10 | 3388 | 3407 | 1168 |
| 560297 | 287 | 306 | TAGATCATAAAAAGACTGAT | 0 | 3391 | 3410 | 1169 |
| 560298 | 289 | 308 | GATAGATCATAAAAAGACTG | 21 | 3393 | 3412 | 1170 |
| 560299 | 291 | 310 | GCGATAGATCATAAAAAGAC | 20 | 3395 | 3414 | 1171 |
| 560300 | 293 | 312 | CAGCGATAGATCATAAAAAG | 16 | 3397 | 3416 | 1172 |

TABLE 8-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560301 | 295 | 314 | TGCAGCGATAGATCATAAAA | 38 | 3399 | 3418 | 1173 |
| 560302 | 297 | 316 | TTTGCAGCGATAGATCATAA | 32 | 3401 | 3420 | 1174 |
| 560303 | 299 | 318 | GGTTTGCAGCGATAGATCAT | 34 | 3403 | 3422 | 1175 |
| 560304 | 301 | 320 | CTGGTTTGCAGCGATAGATC | 25 | 3405 | 3424 | 1176 |
| 560305 | 303 | 322 | CACTGGTTTGCAGCGATAGA | 28 | 3407 | 3426 | 1177 |
| 560306 | 305 | 324 | TTCACTGGTTTGCAGCGATA | 65 | 3409 | 3428 | 34 |
| 560307 | 307 | 326 | ATTTCACTGGTTTGCAGCGA | 23 | 3411 | 3430 | 1178 |
| 560308 | 310 | 329 | TTGATTTCACTGGTTTGCAG | 5 | 3414 | 3433 | 1179 |
| 560309 | 318 | 337 | CTTCTTCTTTGATTTCACTG | 25 | 3422 | 3441 | 1180 |
| 560310 | 327 | 346 | GTTCCTTTTCTTCTTCTTTG | 19 | 3431 | 3450 | 1181 |
| 544120 | 707 | 726 | AGTTCTTGGTGCTCTTGGCT | 77 | 6720 | 6739 | 15 |
| 560311 | 801 | 820 | TTGTATGTTCACCTCTGTTA | 25 | 7386 | 7405 | 1182 |
| 560312 | 802 | 821 | CTTGTATGTTCACCTCTGTT | 37 | 7387 | 7406 | 1183 |
| 337487 | 804 | 823 | CACTTGTATGTTCACCTCTG | 83 | 7389 | 7408 | 28 |
| 560313 | 806 | 825 | GCCACTTGTATGTTCACCTC | 40 | 7391 | 7410 | 1184 |
| 560314 | 807 | 826 | TGCCACTTGTATGTTCACCT | 56 | 7392 | 7411 | 1185 |
| 560315 | 808 | 827 | ATGCCACTTGTATGTTCACC | 39 | 7393 | 7412 | 1186 |
| 337488 | 809 | 828 | CATGCCACTTGTATGTTCAC | 19 | 7394 | 7413 | 1187 |
| 560316 | 810 | 829 | ACATGCCACTTGTATGTTCA | 26 | 7395 | 7414 | 1188 |
| 560317 | 811 | 830 | TACATGCCACTTGTATGTTC | 20 | 7396 | 7415 | 1189 |
| 560318 | 814 | 833 | GCATACATGCCACTTGTATG | 2 | 7399 | 7418 | 1190 |
| 560319 | 815 | 834 | GGCATACATGCCACTTGTAT | 24 | 7400 | 7419 | 1191 |
| 560320 | 816 | 835 | TGGCATACATGCCACTTGTA | 7 | 7401 | 7420 | 1192 |
| 560321 | 817 | 836 | ATGGCATACATGCCACTTGT | 0 | 7402 | 7421 | 1193 |
| 560322 | 821 | 840 | TCTGATGGCATACATGCCAC | 26 | 7406 | 7425 | 1194 |
| 560323 | 822 | 841 | GTCTGATGGCATACATGCCA | 39 | 7407 | 7426 | 1195 |
| 560324 | 824 | 843 | GGGTCTGATGGCATACATGC | 15 | 7409 | 7428 | 1196 |
| 560325 | 825 | 844 | TGGGTCTGATGGCATACATG | 23 | 7410 | 7429 | 1197 |
| 560326 | 826 | 845 | CTGGGTCTGATGGCATACAT | 9 | 7411 | 7430 | 1198 |
| 560327 | 834 | 853 | GAGAGTTGCTGGGTCTGATG | 0 | 7419 | 7438 | 1199 |
| 560328 | 835 | 854 | TGAGAGTTGCTGGGTCTGAT | 2 | 7420 | 7439 | 1200 |
| 560329 | 836 | 855 | TTGAGAGTTGCTGGGTCTGA | 35 | 7421 | 7440 | 1201 |
| 560330 | 837 | 856 | CTTGAGAGTTGCTGGGTCTG | 17 | 7422 | 7441 | 1202 |
| 560331 | 838 | 857 | ACTTGAGAGTTGCTGGGTCT | 0 | 7423 | 7442 | 1203 |
| 560332 | 839 | 858 | AACTTGAGAGTTGCTGGGTC | 13 | 7424 | 7443 | 1204 |

TABLE 8-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560333 | 843 | 862 | GAAAAACTTGAGAGTTGCTG | 22 | 7428 | 7447 | 1205 |
| 560334 | 844 | 863 | TGAAAAACTTGAGAGTTGCT | 16 | 7429 | 7448 | 1206 |
| 560335 | 845 | 864 | ATGAAAAACTTGAGAGTTGC | 10 | 7430 | 7449 | 1207 |
| 560336 | 846 | 865 | CATGAAAAACTTGAGAGTTG | 2 | 7431 | 7450 | 1208 |
| 560337 | 851 | 870 | GTAGACATGAAAAACTTGAG | 13 | 7436 | 7455 | 1209 |
| 560338 | 853 | 872 | CAGTAGACATGAAAAACTTG | 3 | 7438 | 7457 | 1210 |
| 560339 | 861 | 880 | TAACATCACAGTAGACATGA | 30 | 7446 | 7465 | 1211 |
| 560340 | 862 | 881 | ATAACATCACAGTAGACATG | 34 | 7447 | 7466 | 1212 |
| 560341 | 863 | 882 | TATAACATCACAGTAGACAT | 0 | 7448 | 7467 | 1213 |
| 560342 | 864 | 883 | ATATAACATCACAGTAGACA | 10 | 7449 | 7468 | 1214 |
| 560343 | 865 | 884 | GATATAACATCACAGTAGAC | 9 | 7450 | 7469 | 1215 |
| 560344 | 866 | 885 | TGATATAACATCACAGTAGA | 20 | 7451 | 7470 | 1216 |
| 337490 | 867 | 886 | CTGATATAACATCACAGTAG | 24 | 7452 | 7471 | 1217 |
| 560345 | 868 | 887 | CCTGATATAACATCACAGTA | 36 | 7453 | 7472 | 1218 |
| 560346 | 869 | 888 | ACCTGATATAACATCACAGT | 35 | 7454 | 7473 | 1219 |
| 560347 | 870 | 889 | TACCTGATATAACATCACAG | 26 | 7455 | 7474 | 1220 |
| 560348 | 871 | 890 | CTACCTGATATAACATCACA | 38 | N/A | N/A | 1221 |
| 560349 | 872 | 891 | ACTACCTGATATAACATCAC | 12 | N/A | N/A | 1222 |
| 560350 | 873 | 892 | GACTACCTGATATAACATCA | 28 | N/A | N/A | 1223 |
| 560351 | 874 | 893 | GGACTACCTGATATAACATC | 15 | N/A | N/A | 1224 |
| 560352 | 875 | 894 | TGGACTACCTGATATAACAT | 0 | N/A | N/A | 1225 |
| 560353 | 876 | 895 | ATGGACTACCTGATATAACA | 11 | N/A | N/A | 1226 |
| 337491 | 877 | 896 | CATGGACTACCTGATATAAC | 3 | N/A | N/A | 1227 |
| 560354 | 878 | 897 | CCATGGACTACCTGATATAA | 0 | N/A | N/A | 1228 |
| 560355 | 879 | 898 | TCCATGGACTACCTGATATA | 13 | N/A | N/A | 1229 |
| 560356 | 880 | 899 | GTCCATGGACTACCTGATAT | 50 | N/A | N/A | 1230 |
| 560357 | 881 | 900 | TGTCCATGGACTACCTGATA | 12 | N/A | N/A | 1231 |
| 560358 | 882 | 901 | ATGTCCATGGACTACCTGAT | 20 | N/A | N/A | 1232 |
| 560359 | 883 | 902 | AATGTCCATGGACTACCTGA | 16 | 7870 | 7889 | 1233 |
| 560360 | 884 | 903 | TAATGTCCATGGACTACCTG | 26 | 7871 | 7890 | 1234 |
| 560361 | 885 | 904 | TTAATGTCCATGGACTACCT | 31 | 7872 | 7891 | 1235 |
| 560362 | 886 | 905 | ATTAATGTCCATGGACTACC | 42 | 7873 | 7892 | 1236 |
| 560363 | 887 | 906 | AATTAATGTCCATGGACTAC | 21 | 7874 | 7893 | 1237 |
| 560364 | 891 | 910 | GTTGAATTAATGTCCATGGA | 18 | 7878 | 7897 | 1238 |
| 560365 | 892 | 911 | TGTTGAATTAATGTCCATGG | 36 | 7879 | 7898 | 1239 |
| 560366 | 893 | 912 | ATGTTGAATTAATGTCCATG | 13 | 7880 | 7899 | 1240 |

TABLE 8-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560367 | 894 | 913 | GATGTTGAATTAATGTCCAT | 14 | 7881 | 7900 | 1241 |
| 560368 | 895 | 914 | CGATGTTGAATTAATGTCCA | 30 | 7882 | 7901 | 1242 |
| 560369 | 896 | 915 | TCGATGTTGAATTAATGTCC | 29 | 7883 | 7902 | 1243 |
| 560370 | 897 | 916 | TTCGATGTTGAATTAATGTC | 4 | 7884 | 7903 | 1244 |
| 560371 | 898 | 917 | ATTCGATGTTGAATTAATGT | 22 | 7885 | 7904 | 1245 |
| 560372 | 899 | 918 | TATTCGATGTTGAATTAATG | 0 | 7886 | 7905 | 1246 |
| 560373 | 900 | 919 | CTATTCGATGTTGAATTAAT | 0 | 7887 | 7906 | 1247 |
| 337492 | 901 | 920 | TCTATTCGATGTTGAATTAA | 59 | 7888 | 7907 | 29 |
| 560374 | 902 | 921 | ATCTATTCGATGTTGAATTA | 18 | 7889 | 7908 | 1248 |
| 560375 | 903 | 922 | CATCTATTCGATGTTGAATT | 27 | 7890 | 7909 | 1249 |
| 560376 | 904 | 923 | CCATCTATTCGATGTTGAAT | 40 | 7891 | 7910 | 1250 |
| 560377 | 905 | 924 | TCCATCTATTCGATGTTGAA | 23 | 7892 | 7911 | 1251 |
| 560378 | 906 | 925 | ATCCATCTATTCGATGTTGA | 47 | 7893 | 7912 | 1252 |
| 560379 | 907 | 926 | GATCCATCTATTCGATGTTG | 46 | 7894 | 7913 | 1253 |
| 560380 | 908 | 927 | TGATCCATCTATTCGATGTT | 16 | 7895 | 7914 | 1254 |
| 560381 | 909 | 928 | GTGATCCATCTATTCGATGT | 24 | 7896 | 7915 | 1255 |
| 560382 | 910 | 929 | TGTGATCCATCTATTCGATG | 21 | 7897 | 7916 | 1256 |
| 560383 | 911 | 930 | TTGTGATCCATCTATTCGAT | 19 | 7898 | 7917 | 1257 |
| 560384 | 1273 | 1292 | TTTAGGTTGTTTTCTCCACA | 35 | 10245 | 10264 | 1258 |
| 560385 | 1274 | 1293 | ATTTAGGTTGTTTTCTCCAC | 34 | 10246 | 10265 | 1259 |
| 560386 | 1278 | 1297 | TACCATTTAGGTTGTTTTCT | 15 | 10250 | 10269 | 1260 |
| 560387 | 1286 | 1305 | GTTATATTTACCATTTAGGT | 20 | 10258 | 10277 | 1261 |
| 560388 | 1287 | 1306 | TGTTATATTTACCATTTAGG | 17 | 10259 | 10278 | 1262 |
| 560389 | 1288 | 1307 | TTGTTATATTTACCATTTAG | 21 | 10260 | 10279 | 1263 |
| 560390 | 1289 | 1308 | TTTGTTATATTTACCATTTA | 4 | 10261 | 10280 | 1264 |
| 560391 | 1292 | 1311 | TGGTTTGTTATATTTACCAT | 23 | 10264 | 10283 | 1265 |
| 560392 | 1296 | 1315 | CTCTTGGTTTGTTATATTTA | 63 | 10268 | 10287 | 1266 |
| 560393 | 1297 | 1316 | GCTCTTGGTTTGTTATATTT | 61 | 10269 | 10288 | 1267 |
| 560394 | 1298 | 1317 | TGCTCTTGGTTTGTTATATT | 51 | 10270 | 10289 | 1268 |
| 560395 | 1301 | 1320 | TTTTGCTCTTGGTTTGTTAT | 2 | 10273 | 10292 | 1269 |
| 560396 | 1302 | 1321 | ATTTTGCTCTTGGTTTGTTA | 0 | 10274 | 10293 | 1270 |
| 560397 | 1303 | 1322 | GATTTTGCTCTTGGTTTGTT | 0 | 10275 | 10294 | 1271 |
| 560398 | 1304 | 1323 | AGATTTTGCTCTTGGTTTGT | 16 | 10276 | 10295 | 1272 |
| 560399 | 1305 | 1324 | TAGATTTTGCTCTTGGTTTG | 28 | 10277 | 10296 | 1273 |
| 560400 | 1307 | 1326 | CTTAGATTTTGCTCTTGGTT | 69 | 10279 | 10298 | 35 |

TABLE 8-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560401 | 1308 | 1327 | GCTTAGATTTTGCTCTTGGT | 77 | 10280 | 10299 | 36 |
| 560402 | 1309 | 1328 | GGCTTAGATTTTGCTCTTGG | 72 | 10281 | 10300 | 37 |
| 560403 | 1315 | 1334 | CTCTCTGGCTTAGATTTTGC | 38 | 10287 | 10306 | 1274 |
| 560404 | 1316 | 1335 | CCTCTCTGGCTTAGATTTTG | 49 | 10288 | 10307 | 1275 |
| 560405 | 1317 | 1336 | TCCTCTCTGGCTTAGATTTT | 46 | 10289 | 10308 | 1276 |
| 560406 | 1321 | 1340 | CTTCTCCTCTCTGGCTTAGA | 40 | 10293 | 10312 | 1277 |
| 560407 | 1322 | 1341 | TCTTCTCCTCTCTGGCTTAG | 57 | 10294 | 10313 | 1278 |
| 560408 | 1323 | 1342 | CTCTTCTCCTCTCTGGCTTA | 40 | 10295 | 10314 | 1279 |
| 337505 | 1328 | 1347 | TAATCCTCTTCTCCTCTCTG | 28 | 10300 | 10319 | 1280 |
| 560409 | 1329 | 1348 | ATAATCCTCTTCTCCTCTCT | 30 | 10301 | 10320 | 1281 |
| 560410 | 1330 | 1349 | GATAATCCTCTTCTCCTCTC | 9 | 10302 | 10321 | 1282 |
| 560411 | 1331 | 1350 | AGATAATCCTCTTCTCCTCT | 23 | 10303 | 10322 | 1283 |
| 560412 | 1332 | 1351 | AAGATAATCCTCTTCTCCTC | 12 | 10304 | 10323 | 1284 |
| 560413 | 1333 | 1352 | CAAGATAATCCTCTTCTCCT | 40 | 10305 | 10324 | 1285 |
| 560414 | 1334 | 1353 | CCAAGATAATCCTCTTCTCC | 52 | 10306 | 10325 | 1286 |
| 560415 | 1335 | 1354 | TCCAAGATAATCCTCTTCTC | 56 | 10307 | 10326 | 1287 |
| 560416 | 1336 | 1355 | TTCCAAGATAATCCTCTTCT | 60 | 10308 | 10327 | 1288 |
| 560417 | 1337 | 1356 | CTTCCAAGATAATCCTCTTC | 58 | 10309 | 10328 | 1289 |
| 560418 | 1338 | 1357 | ACTTCCAAGATAATCCTCTT | 31 | 10310 | 10329 | 1290 |
| 560419 | 1339 | 1358 | GACTTCCAAGATAATCCTCT | 52 | 10311 | 10330 | 1291 |
| 560420 | 1340 | 1359 | AGACTTCCAAGATAATCCTC | 49 | 10312 | 10331 | 1292 |
| 560421 | 1341 | 1360 | GAGACTTCCAAGATAATCCT | 56 | 10313 | 10332 | 1293 |
| 337506 | 1342 | 1361 | TGAGACTTCCAAGATAATCC | 49 | 10314 | 10333 | 1294 |
| 560422 | 1343 | 1362 | TTGAGACTTCCAAGATAATC | 34 | 10315 | 10334 | 1295 |
| 560423 | 1344 | 1363 | TTTGAGACTTCCAAGATAAT | 14 | 10316 | 10335 | 1296 |
| 560424 | 1345 | 1364 | TTTTGAGACTTCCAAGATAA | 27 | 10317 | 10336 | 1297 |
| 560425 | 1346 | 1365 | ATTTTGAGACTTCCAAGATA | 23 | 10318 | 10337 | 1298 |
| 560426 | 1348 | 1367 | CCATTTTGAGACTTCCAAGA | 40 | 10320 | 10339 | 1299 |
| 560427 | 1351 | 1370 | CTTCCATTTTGAGACTTCCA | 58 | 10323 | 10342 | 1300 |
| 560428 | 1355 | 1374 | TAACCTTCCATTTTGAGACT | 36 | 10327 | 10346 | 1301 |
| 560429 | 1356 | 1375 | ATAACCTTCCATTTTGAGAC | 51 | 10328 | 10347 | 1302 |
| 560430 | 1357 | 1376 | TATAACCTTCCATTTTGAGA | 33 | 10329 | 10348 | 1303 |
| 560431 | 1358 | 1377 | GTATAACCTTCCATTTTGAG | 53 | 10330 | 10349 | 1304 |
| 337508 | 1360 | 1379 | GAGTATAACCTTCCATTTTG | 28 | 10332 | 10351 | 1305 |
| 560432 | 1361 | 1380 | AGAGTATAACCTTCCATTTT | 50 | 10333 | 10352 | 1306 |
| 560433 | 1365 | 1384 | TTATAGAGTATAACCTTCCA | 63 | 10337 | 10356 | 1307 |

TABLE 8-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560434 | 1369 | 1388 | GATTTTATAGAGTATAACCT | 31 | 10341 | 10360 | 1308 |
| 560435 | 1370 | 1389 | TGATTTTATAGAGTATAACC | 6 | 10342 | 10361 | 1309 |
| 560436 | 1371 | 1390 | TTGATTTTATAGAGTATAAC | 14 | 10343 | 10362 | 1310 |
| 560437 | 1372 | 1391 | GTTGATTTTATAGAGTATAA | 2 | 10344 | 10363 | 1311 |
| 560438 | 1376 | 1395 | TTTGGTTGATTTTATAGAGT | 20 | 10348 | 10367 | 1312 |
| 560439 | 1386 | 1405 | GGATCAACATTTTGGTTGAT | 42 | 10358 | 10377 | 1313 |
| 560440 | 1387 | 1406 | TGGATCAACATTTTGGTTGA | 10 | 10359 | 10378 | 1314 |
| 560441 | 1388 | 1407 | ATGGATCAACATTTTGGTTG | 34 | 10360 | 10379 | 1315 |
| 560442 | 1398 | 1417 | AATCTGTTGGATGGATCAAC | 52 | 10370 | 10389 | 1316 |
| 560443 | 1399 | 1418 | GAATCTGTTGGATGGATCAA | 47 | 10371 | 10390 | 1317 |
| 560444 | 1403 | 1422 | TTCTGAATCTGTTGGATGGA | 30 | 10375 | 10394 | 1318 |
| 560445 | 1404 | 1423 | TTTCTGAATCTGTTGGATGG | 34 | 10376 | 10395 | 1319 |
| 560446 | 1405 | 1424 | CTTTCTGAATCTGTTGGATG | 50 | 10377 | 10396 | 1320 |
| 560447 | 1409 | 1428 | AAAGCTTTCTGAATCTGTTG | 29 | 10381 | 10400 | 1321 |
| 560448 | 1425 | 1444 | TTGCCTCAGTTCATTCAAAG | 38 | 10397 | 10416 | 1322 |
| 560449 | 1429 | 1448 | AAATTTGCCTCAGTTCATTC | 27 | 10401 | 10420 | 1323 |
| 560450 | 1434 | 1453 | CTTTTAAATTTGCCTCAGTT | 34 | 10406 | 10425 | 1324 |
| 560451 | 1440 | 1459 | TATTGCCTTTTAAATTTGCC | 21 | 10412 | 10431 | 1325 |
| 560452 | 1441 | 1460 | TTATTGCCTTTTAAATTTGC | 23 | 10413 | 10432 | 1326 |
| 560453 | 1446 | 1465 | TTAAATTATTGCCTTTTAAA | 1 | 10418 | 10437 | 1327 |
| 560454 | 1447 | 1466 | TTTAAATTATTGCCTTTTAA | 1 | 10419 | 10438 | 1328 |
| 560455 | 1448 | 1467 | GTTTAAATTATTGCCTTTTA | 48 | 10420 | 10439 | 1329 |
| 560456 | 1449 | 1468 | TGTTTAAATTATTGCCTTTT | 25 | 10421 | 10440 | 1330 |
| 560457 | 1450 | 1469 | ATGTTTAAATTATTGCCTTT | 0 | 10422 | 10441 | 1331 |
| 560458 | 1704 | 1723 | TTTAATAAGTTCACCTATTG | 26 | 10676 | 10695 | 1332 |
| 560459 | 1705 | 1724 | ATTTAATAAGTTCACCTATT | 26 | 10677 | 10696 | 1333 |
| 560460 | 1706 | 1725 | TATTTAATAAGTTCACCTAT | 16 | 10678 | 10697 | 1334 |
| 560461 | 1707 | 1726 | TTATTTAATAAGTTCACCTA | 4 | 10679 | 10698 | 1335 |
| 560462 | 1708 | 1727 | GTTATTTAATAAGTTCACCT | 36 | 10680 | 10699 | 1336 |
| 560463 | 1709 | 1728 | AGTTATTTAATAAGTTCACC | 0 | 10681 | 10700 | 1337 |
| 560464 | 1712 | 1731 | AAAGTTATTTAATAAGTTC | 12 | 10684 | 10703 | 1338 |
| 560465 | 1719 | 1738 | TATTTAGAAAAGTTATTTAA | 0 | 10691 | 10710 | 1339 |
| 560466 | 1738 | 1757 | TAAAAGTCTCTAAATTTTTT | 0 | 10710 | 10729 | 1340 |
| 560467 | 1739 | 1758 | ATAAAAGTCTCTAAATTTTT | 0 | 10711 | 10730 | 1341 |
| 560468 | 1740 | 1759 | AATAAAAGTCTCTAAATTTT | 25 | 10712 | 10731 | 1342 |

TABLE 8-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560469 | 1760 | 1779 | GCTCATATGATGCCTTTAA | 77 | 10732 | 10751 | 38 |
| 560470 | 1761 | 1780 | AGCTCATATGATGCCTTTA | 73 | 10733 | 10752 | 39 |
| 560471 | 1762 | 1781 | TAGCTCATATGATGCCTTT | 67 | 10734 | 10753 | 40 |
| 560472 | 1763 | 1782 | TTAGCTCATATGATGCCTT | 42 | 10735 | 10754 | 1343 |
| 560473 | 1764 | 1783 | ATTAGCTCATATGATGCCT | 61 | 10736 | 10755 | 1344 |
| 560474 | 1765 | 1784 | TATTAGCTCATATGATGCC | 55 | 10737 | 10756 | 41 |
| 560475 | 1766 | 1785 | ATATTAGCTCATATGATGC | 42 | 10738 | 10757 | 1345 |
| 560476 | 1767 | 1786 | GATATTAGCTCATATGATG | 36 | 10739 | 10758 | 1346 |
| 560477 | 1768 | 1787 | TGATATTAGCTCATATGAT | 21 | 10740 | 10759 | 1347 |
| 560478 | 1769 | 1788 | GTGATATTAGCTCATATGA | 40 | 10741 | 10760 | 1348 |
| 560479 | 1776 | 1795 | GAAAGTTGTGATATTAGCTC | 43 | 10748 | 10767 | 1349 |
| 560480 | 1777 | 1796 | GGAAAGTTGTGATATTAGCT | 19 | 10749 | 10768 | 1350 |
| 560481 | 1778 | 1797 | GGGAAAGTTGTGATATTAGC | 17 | 10750 | 10769 | 1351 |
| 560482 | 1779 | 1798 | TGGGAAAGTTGTGATATTAG | 29 | 10751 | 10770 | 1352 |
| 560483 | 1780 | 1799 | CTGGGAAAGTTGTGATATTA | 35 | 10752 | 10771 | 1353 |
| 560484 | 1781 | 1800 | ACTGGGAAAGTTGTGATATT | 25 | 10753 | 10772 | 1354 |
| 560485 | 1782 | 1801 | AACTGGGAAAGTTGTGATAT | 12 | 10754 | 10773 | 1355 |
| 560486 | 1783 | 1802 | AAACTGGGAAAGTTGTGATA | 21 | 10755 | 10774 | 1356 |
| 560487 | 1784 | 1803 | TAAACTGGGAAAGTTGTGAT | 22 | 10756 | 10775 | 1357 |
| 560488 | 1785 | 1804 | TTAAACTGGGAAAGTTGTGA | 12 | 10757 | 10776 | 1358 |
| 560489 | 1786 | 1805 | TTTAAACTGGGAAAGTTGTG | 22 | 10758 | 10777 | 1359 |
| 560490 | 1787 | 1806 | TTTTAAACTGGGAAAGTTGT | 23 | 10759 | 10778 | 1360 |
| 560491 | 1790 | 1809 | GTTTTTTAAACTGGGAAAGT | 1 | 10762 | 10781 | 1361 |
| 560492 | 1791 | 1810 | AGTTTTTTAAACTGGGAAAG | 0 | 10763 | 10782 | 1362 |
| 560493 | 1792 | 1811 | TAGTTTTTTAAACTGGGAAA | 0 | 10764 | 10783 | 1363 |
| 560494 | 1796 | 1815 | GTACTAGTTTTTTAAACTGG | 23 | 10768 | 10787 | 1364 |
| 560495 | 1799 | 1818 | AGAGTACTAGTTTTTTAAAC | 0 | 10771 | 10790 | 1365 |
| 560496 | 1801 | 1820 | CAAGAGTACTAGTTTTTTAA | 0 | 10773 | 10792 | 1366 |
| 560497 | 1806 | 1825 | TTTAACAAGAGTACTAGTTT | 21 | 10778 | 10797 | 1367 |
| 560498 | 1807 | 1826 | TTTTAACAAGAGTACTAGTT | 19 | 10779 | 10798 | 1368 |
| 560499 | 1808 | 1827 | GTTTTAACAAGAGTACTAGT | 37 | 10780 | 10799 | 1369 |
| 560500 | 1809 | 1828 | AGTTTTAACAAGAGTACTAG | 20 | 10781 | 10800 | 1370 |
| 560501 | 1810 | 1829 | GAGTTTTAACAAGAGTACTA | 21 | 10782 | 10801 | 1371 |
| 560502 | 1811 | 1830 | AGAGTTTTAACAAGAGTACT | 0 | 10783 | 10802 | 1372 |
| 560503 | 1814 | 1833 | TTTAGAGTTTTAACAAGAGT | 0 | 10786 | 10805 | 1373 |
| 560504 | 1815 | 1834 | GTTTAGAGTTTTAACAAGAG | 18 | 10787 | 10806 | 1374 |

TABLE 8-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560505 | 1817 | 1836 | AAGTTTAGAGTTTTAACAAG | 9 | 10789 | 10808 | 1375 |
| 560506 | 1818 | 1837 | CAAGTTTAGAGTTTTAACAA | 1 | 10790 | 10809 | 1376 |
| 560507 | 1822 | 1841 | TAGTCAAGTTTAGAGTTTTA | 21 | 10794 | 10813 | 1377 |
| 560508 | 1823 | 1842 | TTAGTCAAGTTTAGAGTTTT | 10 | 10795 | 10814 | 1378 |
| 560509 | 1824 | 1843 | TTTAGTCAAGTTTAGAGTTT | 20 | 10796 | 10815 | 1379 |
| 560510 | 1828 | 1847 | TGTATTTAGTCAAGTTTAGA | 8 | 10800 | 10819 | 1380 |
| 560511 | 1829 | 1848 | CTGTATTTAGTCAAGTTTAG | 37 | 10801 | 10820 | 1381 |
| 560512 | 1830 | 1849 | TCTGTATTTAGTCAAGTTTA | 46 | 10802 | 10821 | 1382 |
| 560513 | 1834 | 1853 | GTCCTCTGTATTTAGTCAAG | 38 | 10806 | 10825 | 1383 |
| 560514 | 1835 | 1854 | AGTCCTCTGTATTTAGTCAA | 29 | 10807 | 10826 | 1384 |
| 560515 | 1836 | 1855 | CAGTCCTCTGTATTTAGTCA | 47 | 10808 | 10827 | 1385 |
| 560516 | 1837 | 1856 | CCAGTCCTCTGTATTTAGTC | 31 | 10809 | 10828 | 1386 |
| 560517 | 1838 | 1857 | ACCAGTCCTCTGTATTTAGT | 31 | 10810 | 10829 | 1387 |
| 560518 | 1839 | 1858 | TACCAGTCCTCTGTATTTAG | 35 | 10811 | 10830 | 1388 |
| 560519 | 1840 | 1859 | TTACCAGTCCTCTGTATTTA | 30 | 10812 | 10831 | 1389 |
| 560520 | 1841 | 1860 | ATTACCAGTCCTCTGTATTT | 37 | 10813 | 10832 | 1390 |
| 560521 | 1842 | 1861 | AATTACCAGTCCTCTGTATT | 12 | 10814 | 10833 | 1391 |
| 560522 | 1843 | 1862 | CAATTACCAGTCCTCTGTAT | 38 | 10815 | 10834 | 1392 |
| 560523 | 1844 | 1863 | ACAATTACCAGTCCTCTGTA | 35 | 10816 | 10835 | 1393 |
| 560524 | 1845 | 1864 | TACAATTACCAGTCCTCTGT | 51 | 10817 | 10836 | 1394 |
| 560525 | 1846 | 1865 | GTACAATTACCAGTCCTCTG | 52 | 10818 | 10837 | 1395 |
| 560526 | 1847 | 1866 | TGTACAATTACCAGTCCTCT | 38 | 10819 | 10838 | 1396 |
| 560527 | 1848 | 1867 | CTGTACAATTACCAGTCCTC | 19 | 10820 | 10839 | 1397 |
| 560528 | 1849 | 1868 | ACTGTACAATTACCAGTCCT | 13 | 10821 | 10840 | 1398 |
| 560529 | 1850 | 1869 | AACTGTACAATTACCAGTCC | 27 | 10822 | 10841 | 1399 |
| 560530 | 1851 | 1870 | GAACTGTACAATTACCAGTC | 20 | 10823 | 10842 | 1400 |
| 560531 | 1852 | 1871 | AGAACTGTACAATTACCAGT | 24 | 10824 | 10843 | 1401 |
| 560532 | 1854 | 1873 | TAAGAACTGTACAATTACCA | 22 | 10826 | 10845 | 1402 |
| 560533 | 1855 | 1874 | TTAAGAACTGTACAATTACC | 20 | 10827 | 10846 | 1403 |
| 560534 | 1856 | 1875 | TTTAAGAACTGTACAATTAC | 1 | 10828 | 10847 | 1404 |

TABLE 9

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544355 | N/A | N/A | TTTCAGCATGTATCTCTTAA | 69 | 7065 | 7084 | 21 |
| 544376 | N/A | N/A | GGAGTGGTTCTTTTCACAGC | 64 | 8298 | 8317 | 24 |
| 544380 | N/A | N/A | TGGTCCTTTTAACTTCCAAT | 50 | 8365 | 8384 | 25 |
| 560612 | N/A | N/A | ACTTGAAATTATAATAGGAA | 0 | 3798 | 3817 | 1405 |
| 560613 | N/A | N/A | AAAAAACTAACTTGAAATTA | 0 | 3807 | 3826 | 1406 |
| 560614 | N/A | N/A | GAAACAAAAACTAACTTGA | 21 | 3812 | 3831 | 1407 |
| 560615 | N/A | N/A | GTGTTTTCATATATAACATT | 19 | 3835 | 3854 | 1408 |
| 560616 | N/A | N/A | AATTTTCAGTGTTTTCATAT | 0 | 3843 | 3862 | 1409 |
| 560617 | N/A | N/A | AAAATGCAAATTTTCAGTGT | 0 | 3851 | 3870 | 1410 |
| 560618 | N/A | N/A | GTAATTTTCATATAAAATGC | 0 | 3864 | 3883 | 1411 |
| 560619 | N/A | N/A | GATTTGTAATTTTCATATAA | 0 | 3869 | 3888 | 1412 |
| 560620 | N/A | N/A | TAACCGATTTGTAATTTTCA | 16 | 3874 | 3893 | 1413 |
| 560621 | N/A | N/A | TAATTTAACCGATTTGTAAT | 5 | 3879 | 3898 | 1414 |
| 560622 | N/A | N/A | TTGTATAATTTAACCGATTT | 13 | 3884 | 3903 | 1415 |
| 560623 | N/A | N/A | CTAGATTGTATAATTTAACC | 8 | 3889 | 3908 | 1416 |
| 560624 | N/A | N/A | GTGTTCTAGATTGTATAATT | 24 | 3894 | 3913 | 1417 |
| 560625 | N/A | N/A | AATGACATAGTGTTCTAGAT | 0 | 3903 | 3922 | 1418 |
| 560626 | N/A | N/A | AGTGTAATGACATAGTGTTC | 10 | 3908 | 3927 | 1419 |
| 560627 | N/A | N/A | TTACAATAGTGTAATGACAT | 0 | 3915 | 3934 | 1420 |
| 560628 | N/A | N/A | TTCAGTAATTTACAATAGTG | 12 | 3924 | 3943 | 1421 |
| 560629 | N/A | N/A | TTACCTTCAGTAATTTACAA | 9 | 3929 | 3948 | 1422 |
| 560630 | N/A | N/A | TTAACTTTTTACTTACCTTC | 7 | 3941 | 3960 | 1423 |
| 560631 | N/A | N/A | GAATAGTTTTAAATTTTTTT | 0 | 3960 | 3979 | 1424 |
| 560632 | N/A | N/A | ACACTGGAGAATAGTTTTAA | 10 | 3968 | 3987 | 1425 |
| 560633 | N/A | N/A | TTTAAACACTGGAGAATAGT | 0 | 3973 | 3992 | 1426 |
| 560634 | N/A | N/A | TCTGTTTTAAACACTGGAGA | 25 | 3978 | 3997 | 1427 |
| 560635 | N/A | N/A | GTATTATTTAATCTGTTTTA | 0 | 3989 | 4008 | 1428 |
| 560636 | N/A | N/A | TTACTGTATTATTTAATCTG | 5 | 3994 | 4013 | 1429 |
| 560637 | N/A | N/A | TAAATCTTTTCCATTTACTG | 18 | 4008 | 4027 | 1430 |
| 560638 | N/A | N/A | ATGAATAAATCTTTTCCATT | 12 | 4013 | 4032 | 1431 |
| 560639 | N/A | N/A | GCATATTTTCATATGAATAA | 9 | 4025 | 4044 | 1432 |
| 560640 | N/A | N/A | GCCCAGCATATTTTCATATG | 20 | 4030 | 4049 | 1433 |
| 560641 | N/A | N/A | AAAAGAAAAGCCCAGCATA | 20 | 4040 | 4059 | 1434 |
| 560642 | N/A | N/A | CTGAACTTCAATTAAAAGAA | 5 | 4053 | 4072 | 1435 |
| 560643 | N/A | N/A | GATTTTCTGAACTTCAATTA | 9 | 4059 | 4078 | 1436 |
| 560644 | N/A | N/A | TCTAAAATTTGATTTTCTGA | 0 | 4069 | 4088 | 1437 |

TABLE 9-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560645 | N/A | N/A | ACTATCTCTAAAATTGATT | 8 | 4075 | 4094 | 1438 |
| 560646 | N/A | N/A | TTAAATTGTACTATCTCTAA | 5 | 4084 | 4103 | 1439 |
| 560647 | N/A | N/A | ACATTTTATTTAAATTGTAC | 17 | 4093 | 4112 | 1440 |
| 560648 | N/A | N/A | GTCCTTAACATTTTATTTAA | 0 | 4100 | 4119 | 1441 |
| 560649 | N/A | N/A | CATATTTTGTCCTTAACAT | 0 | 4109 | 4128 | 1442 |
| 560650 | N/A | N/A | TAGCACATATTTTGTCCTT | 25 | 4114 | 4133 | 1443 |
| 560651 | N/A | N/A | TCAAATAGCACATATTTTG | 0 | 4119 | 4138 | 1444 |
| 560652 | N/A | N/A | CTTCTTTCAAATAGCACATA | 41 | 4125 | 4144 | 1445 |
| 560653 | N/A | N/A | CTTGTATGCTTCTTTCAAAT | 19 | 4133 | 4152 | 1446 |
| 560654 | N/A | N/A | ATTCCTTCCCCTTGTATGCT | 12 | 4143 | 4162 | 1447 |
| 560655 | N/A | N/A | TTGGCAATTCCTTCCCCTTG | 36 | 4149 | 4168 | 1448 |
| 560656 | N/A | N/A | GAATATTGGCAATTCCTTCC | 38 | 4154 | 4173 | 1449 |
| 560657 | N/A | N/A | TGAAAAATGAATATTGGCAA | 0 | 4162 | 4181 | 1450 |
| 560658 | N/A | N/A | TAATGGATTTGAAAAATGAA | 0 | 4171 | 4190 | 1451 |
| 560659 | N/A | N/A | ACTAATAATGGATTTGAAAA | 1 | 4176 | 4195 | 1452 |
| 560660 | N/A | N/A | CATAATCTAAATTTTTAAAC | 6 | 4194 | 4213 | 1453 |
| 560661 | N/A | N/A | CACTATCATAATCTAAATTT | 4 | 4200 | 4219 | 1454 |
| 560662 | N/A | N/A | AATTTCCTGTAACACTATCA | 2 | 4212 | 4231 | 1455 |
| 560663 | N/A | N/A | CTATTAATTTCCTGTAACAC | 9 | 4217 | 4236 | 1456 |
| 560664 | N/A | N/A | CTTTTCTATTAATTTCCTGT | 5 | 4222 | 4241 | 1457 |
| 560665 | N/A | N/A | CTCTTTCTTTTCTATTAATT | 0 | 4228 | 4247 | 1458 |
| 560666 | N/A | N/A | AGTTGCTTTCCTCTTTCTTT | 0 | 4238 | 4257 | 1459 |
| 560667 | N/A | N/A | TTATAAGTTGCTTTCCTCTT | 10 | 4243 | 4262 | 1460 |
| 560668 | N/A | N/A | GTTGGTTATAAGTTGCTTTC | 6 | 4248 | 4267 | 1461 |
| 560669 | N/A | N/A | AGTAGGTTGGTTATAAGTTG | 4 | 4253 | 4272 | 1462 |
| 560670 | N/A | N/A | TAGAGAGTAGGTTGGTTATA | 0 | 4258 | 4277 | 1463 |
| 560671 | N/A | N/A | GGATATAGAGAGTAGGTTGG | 0 | 4263 | 4282 | 1464 |
| 560672 | N/A | N/A | AGTCTGGATATAGAGAGTAG | 0 | 4268 | 4287 | 1465 |
| 560673 | N/A | N/A | TACAAAGTCTGGATATAGA | 7 | 4274 | 4293 | 1466 |
| 560674 | N/A | N/A | GTTTTTCTACAAAGTCTGG | 12 | 4281 | 4300 | 1467 |
| 560675 | N/A | N/A | TTACCTGATTTTCTATTTCT | 15 | 4380 | 4399 | 1468 |
| 560676 | N/A | N/A | ATACTGACTTACCTGATTTT | 15 | 4388 | 4407 | 1469 |
| 560677 | N/A | N/A | TTAAAATACTGACTTACCTG | 2 | 4393 | 4412 | 1470 |
| 560678 | N/A | N/A | TACCATTAAAATACTGACTT | 0 | 4398 | 4417 | 1471 |
| 560679 | N/A | N/A | GGACATACCATTAAAATACT | 7 | 4403 | 4422 | 1472 |

TABLE 9-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560680 | N/A | N/A | AAAGATGGGACATACCATTA | 0 | 4410 | 4429 | 1473 |
| 560681 | N/A | N/A | AGACCTGTGTGAAAGATGGG | 19 | 4421 | 4440 | 1474 |
| 560682 | N/A | N/A | TTTACAGACCTGTGTGAAAG | 22 | 4426 | 4445 | 1475 |
| 560683 | N/A | N/A | GTGTTTTACAGACCTGTGT | 47 | 4431 | 4450 | 1476 |
| 560684 | N/A | N/A | ATTCAGTGTTTTTACAGACC | 44 | 4436 | 4455 | 1477 |
| 560685 | N/A | N/A | TTAGGATTCAGTGTTTTTAC | 46 | 4441 | 4460 | 1478 |
| 560686 | N/A | N/A | ATAATTTTAGGATTCAGTGT | 15 | 4447 | 4466 | 1479 |
| 560687 | N/A | N/A | GCTTGTAAATAATTTTAGGA | 0 | 4455 | 4474 | 1480 |
| 560688 | N/A | N/A | GTTAAAGCTTGTAAATAATT | 0 | 4461 | 4480 | 1481 |
| 560689 | N/A | N/A | TGTTTTATATCTCTTGAAAA | 0 | 5571 | 5590 | 1482 |
| 560690 | N/A | N/A | TTGGTAATAATATTTGTTTT | 9 | 5585 | 5604 | 1483 |
| 560691 | N/A | N/A | GGAAATTGGTAATAATATTT | 0 | 5590 | 5609 | 1484 |
| 560692 | N/A | N/A | TTAGTGGAAATTGGTAATAA | 22 | 5595 | 5614 | 1485 |
| 560693 | N/A | N/A | TTTGTTTAGTGGAAATTGGT | 8 | 5600 | 5619 | 1486 |
| 560694 | N/A | N/A | TTATGTTTGTTTAGTGGAAA | 0 | 5605 | 5624 | 1487 |
| 560695 | N/A | N/A | TAACATTATGTTTGTTTAGT | 12 | 5610 | 5629 | 1488 |
| 560696 | N/A | N/A | ACTACTAACATTATGTTTGT | 4 | 5615 | 5634 | 1489 |
| 560697 | N/A | N/A | GCAGCACTACTAACATTATG | 38 | 5620 | 5639 | 1490 |
| 560698 | N/A | N/A | TTTTAGCAGCACTACTAACA | 15 | 5625 | 5644 | 1491 |
| 560699 | N/A | N/A | AAACCTTTTAGCAGCACTAC | 52 | 5630 | 5649 | 1492 |
| 560700 | N/A | N/A | GATAAAAACCTTTTAGCAG | 0 | 5636 | 5655 | 1493 |
| 560701 | N/A | N/A | TAGTTGATAAAAACCTTTT | 0 | 5641 | 5660 | 1494 |
| 560702 | N/A | N/A | CAAAAGTAGTTGATAAAAAA | 0 | 5647 | 5666 | 1495 |
| 560703 | N/A | N/A | ATGGAAACCAAAAGTAGTTG | 13 | 5655 | 5674 | 1496 |
| 560704 | N/A | N/A | AAAGTATGGAAACCAAAAGT | 20 | 5660 | 5679 | 1497 |
| 560705 | N/A | N/A | GAAGGAAAGTATGGAAACCA | 45 | 5665 | 5684 | 1498 |
| 560706 | N/A | N/A | CATAAGAAGGAAAGTATGGA | 10 | 5670 | 5689 | 1499 |
| 560707 | N/A | N/A | TAACATCATAAGAAGGAAAG | 0 | 5676 | 5695 | 1500 |
| 560708 | N/A | N/A | GAATAATAACATCATAAGAA | 0 | 5682 | 5701 | 1501 |
| 560709 | N/A | N/A | GAATTTAGAATAATAACATC | 1 | 5689 | 5708 | 1502 |
| 560710 | N/A | N/A | TATAATTGAAAAGAATTTAG | 8 | 5701 | 5720 | 1503 |
| 560711 | N/A | N/A | TAGTAAAAGATATAATTGAA | 0 | 5711 | 5730 | 1504 |
| 560712 | N/A | N/A | AATCATAGTAAAAGATATAA | 10 | 5716 | 5735 | 1505 |
| 560713 | N/A | N/A | CAGGTTCATTTAATCATAGT | 43 | 5727 | 5746 | 1506 |
| 560714 | N/A | N/A | CTATAGTAACATTTTGCTTT | 24 | 5753 | 5772 | 1507 |
| 560715 | N/A | N/A | GTATATTACTATAGTAACAT | 18 | 5761 | 5780 | 1508 |

TABLE 9-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560716 | N/A | N/A | ACAATGTATATTACTATAGT | 0 | 5766 | 5785 | 1509 |
| 560717 | N/A | N/A | TAGACACAATGTATATTACT | 46 | 5771 | 5790 | 1510 |
| 560718 | N/A | N/A | TATTTTTAGACACAATGTAT | 29 | 5777 | 5796 | 1511 |
| 560719 | N/A | N/A | ACACATTTTATTTTTAGAC | 15 | 5786 | 5805 | 1512 |
| 560720 | N/A | N/A | TTGGTTTCTTCACACATTTT | 62 | 5797 | 5816 | 1513 |
| 560721 | N/A | N/A | TTCATTGTTTTGGTTTCTTC | 55 | 5806 | 5825 | 1514 |
| 560722 | N/A | N/A | CAGAAATTCATTGTTTTGGT | 55 | 5812 | 5831 | 1515 |
| 560723 | N/A | N/A | TCCAACTCAGAAATTCATTG | 65 | 5819 | 5838 | 48 |
| 560724 | N/A | N/A | CTTCTTCCAACTCAGAAATT | 41 | 5824 | 5843 | 1516 |
| 560725 | N/A | N/A | TGATCTAACTCTTCTTCCAA | 24 | 5834 | 5853 | 1517 |
| 560726 | N/A | N/A | TTAAATGATCTAACTCTTCT | 23 | 5839 | 5858 | 1518 |
| 560727 | N/A | N/A | TGAGAAAGTTAAATGATCTA | 0 | 5847 | 5866 | 1519 |
| 560728 | N/A | N/A | TACTTAAATTTTTAGAGTTT | 10 | 5886 | 5905 | 1520 |
| 560729 | N/A | N/A | AAAGTTACTTAAATTTTTAG | 3 | 5891 | 5910 | 1521 |
| 560730 | N/A | N/A | ATCTTAAAGTTACTTAAATT | 0 | 5896 | 5915 | 1522 |
| 560731 | N/A | N/A | ATGTGATCTTAAAGTTACTT | 24 | 5901 | 5920 | 1523 |
| 560732 | N/A | N/A | TAACTATGTGATCTTAAAGT | 0 | 5906 | 5925 | 1524 |
| 560733 | N/A | N/A | TTACTCTTTTCTACTAAGTA | 39 | 5924 | 5943 | 1525 |
| 560734 | N/A | N/A | GGGTATTACTCTTTTCTACT | 48 | 5929 | 5948 | 1526 |
| 560735 | N/A | N/A | TTGCTGGGTATTACTCTTTT | 75 | 5934 | 5953 | 49 |
| 560736 | N/A | N/A | TTTGCTTGCTGGGTATTACT | 65 | 5939 | 5958 | 50 |
| 560737 | N/A | N/A | TAAAGTTTGCTTGCTGGGTA | 49 | 5944 | 5963 | 1527 |
| 560738 | N/A | N/A | TATTGTAAAGTTTGCTTGCT | 15 | 5949 | 5968 | 1528 |
| 560739 | N/A | N/A | TAAAAGGATCTATTGTAAAG | 0 | 5959 | 5978 | 1529 |
| 560740 | N/A | N/A | TTATTTAAAAGGATCTATTG | 9 | 5964 | 5983 | 1530 |
| 560741 | N/A | N/A | GGACCTTATTTAAAAGGATC | 17 | 5969 | 5988 | 1531 |
| 560742 | N/A | N/A | GATATTTCCTAGGACCTTAT | 27 | 5980 | 5999 | 1532 |
| 560743 | N/A | N/A | TGAATGATATTTCCTAGGAC | 0 | 5985 | 6004 | 1533 |
| 560744 | N/A | N/A | TGGCATGAATGATATTTCCT | 74 | 5990 | 6009 | 51 |
| 560745 | N/A | N/A | GATGCTGGCATGAATGATAT | 40 | 5995 | 6014 | 1534 |
| 560746 | N/A | N/A | TTTTTTGATGCTGGCATGAA | 38 | 6001 | 6020 | 1535 |
| 560747 | N/A | N/A | GTTAGTTTTTGATGCTGGC | 35 | 6006 | 6025 | 1536 |
| 560748 | N/A | N/A | TTAGTGTTAGTTTTTTGATG | 0 | 6011 | 6030 | 1537 |
| 560749 | N/A | N/A | GCATTATTAGTGTTAGTTTT | 50 | 6017 | 6036 | 1538 |
| 560750 | N/A | N/A | ATCTTGCATTATTAGTGTTA | 49 | 6022 | 6041 | 1539 |

TABLE 9-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560751 | N/A | N/A | ATAATATCTTGCATTATTAG | 17 | 6027 | 6046 | 1540 |
| 560752 | N/A | N/A | CAGTAAGAAAAGCAGAATAT | 15 | 6047 | 6066 | 1541 |
| 560753 | N/A | N/A | TCATTGACAGTAAGAAAAGC | 47 | 6054 | 6073 | 1542 |
| 560754 | N/A | N/A | GATAGTTTTTCTCATTGACA | 40 | 6065 | 6084 | 1543 |
| 560755 | N/A | N/A | GTTTGCAATTTATTGAATGA | 12 | 6083 | 6102 | 1544 |
| 560756 | N/A | N/A | GTGTTGGGTTTGCAATTTAT | 55 | 6090 | 6109 | 1545 |
| 560757 | N/A | N/A | TTAAGTGTGTTGGGTTTGCA | 50 | 6096 | 6115 | 1546 |
| 560758 | N/A | N/A | TTTTATTTAAGTGTGTTGGG | 5 | 6102 | 6121 | 1547 |
| 560759 | N/A | N/A | TTTAGCAGTAACATTTTATT | 19 | 6121 | 6140 | 1548 |
| 560760 | N/A | N/A | GTTAGTTTAGCAGTAACATT | 30 | 6126 | 6145 | 1549 |
| 560761 | N/A | N/A | TCTATATATTCAGTAGTTTA | 17 | 6148 | 6167 | 1550 |
| 560762 | N/A | N/A | TTACTTTCTATATATTCAGT | 14 | 6154 | 6173 | 1551 |
| 560763 | N/A | N/A | GTTTGCTTACTTTCTATATA | 20 | 6160 | 6179 | 1552 |
| 560764 | N/A | N/A | AGTTTGTTTGCTTACTTTCT | 36 | 6165 | 6184 | 1553 |
| 560765 | N/A | N/A | TGGCAAGTTTGTTTGCTTAC | 43 | 6170 | 6189 | 1554 |
| 560766 | N/A | N/A | TTACTGTTACTGTATTTCCC | 39 | 10155 | 10174 | 1555 |
| 560767 | N/A | N/A | ATGTAGTTACTGTTACTGTA | 18 | 10161 | 10180 | 1556 |
| 560768 | N/A | N/A | ATTTAATGGGTACAGACTCG | 47 | 10182 | 10201 | 61 |
| 560769 | N/A | N/A | ATGCAATTTAATGGGTACAG | 32 | 10187 | 10206 | 1557 |
| 560770 | N/A | N/A | TAGATATGCAATTTAATGGG | 4 | 10192 | 10211 | 1558 |
| 560771 | N/A | N/A | AGGAGATAGATATGCAATTT | 5 | 10198 | 10217 | 1559 |
| 560772 | N/A | N/A | CCTAAAGGAGATAGATATGC | 36 | 10203 | 10222 | 1560 |
| 560773 | N/A | N/A | AGCCTCCTAAAGGAGATAGA | 0 | 10208 | 10227 | 1561 |
| 560774 | N/A | N/A | CACCACCAGCCTCCTAAAGG | 35 | 10215 | 10234 | 1562 |
| 560775 | N/A | N/A | ATCTAAGAAAATTAATAAAC | 17 | 7003 | 7022 | 1563 |
| 560776 | N/A | N/A | ATGATCACATCTAAGAAAAT | 8 | 7011 | 7030 | 1564 |
| 560777 | N/A | N/A | ATACCATGATCACATCTAAG | 49 | 7016 | 7035 | 62 |
| 560778 | N/A | N/A | GCAATACCATGATCACATCT | 59 | 7019 | 7038 | 52 |
| 560779 | N/A | N/A | AACTGCAATACCATGATCAC | 35 | 7023 | 7042 | 1565 |
| 560780 | N/A | N/A | TAAAACTGCAATACCATGAT | 43 | 7026 | 7045 | 1566 |
| 560781 | N/A | N/A | CTTTAAAACTGCAATACCAT | 13 | 7029 | 7048 | 1567 |
| 560782 | N/A | N/A | TCTCCTTTAAAACTGCAATA | 18 | 7033 | 7052 | 1568 |
| 560783 | N/A | N/A | TGTTCTCCTTTAAAACTGCA | 13 | 7036 | 7055 | 1569 |
| 560784 | N/A | N/A | GATTGTTCTCCTTTAAAACT | 23 | 7039 | 7058 | 1570 |
| 560785 | N/A | N/A | AGGAGATTGTTCTCCTTTAA | 14 | 7043 | 7062 | 1571 |
| 560786 | N/A | N/A | AACAGGAGATTGTTCTCCTT | 0 | 7046 | 7065 | 1572 |

TABLE 9-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560787 | N/A | N/A | TTAAACAGGAGATTGTTCTC | 7 | 7049 | 7068 | 1573 |
| 560788 | N/A | N/A | CTCTTAAACAGGAGATTGTT | 10 | 7052 | 7071 | 1574 |
| 560789 | N/A | N/A | ACTCCGTAAATATTTCAGCA | 55 | 7077 | 7096 | 53 |
| 560790 | N/A | N/A | CTTTAACTCCGTAAATATTT | 22 | 7082 | 7101 | 1575 |
| 560791 | N/A | N/A | GACCTTTAACTCCGTAAATA | 54 | 7085 | 7104 | 63 |
| 560792 | N/A | N/A | AGTGACCTTTAACTCCGTAA | 35 | 7088 | 7107 | 1576 |
| 560793 | N/A | N/A | GGAGTCCAGTGACCTTTAAC | 15 | 7095 | 7114 | 1577 |
| 560794 | N/A | N/A | TCTGGAGTCCAGTGACCTTT | 46 | 7098 | 7117 | 64 |
| 560795 | N/A | N/A | ACCAGTCTGGAGTCCAGTGA | 8 | 7103 | 7122 | 1578 |
| 560796 | N/A | N/A | TCATCTTACCAAACTATTTT | 22 | 7169 | 7188 | 1579 |
| 560797 | N/A | N/A | GAATCATCTTACCAAACTAT | 39 | 7172 | 7191 | 1580 |
| 560798 | N/A | N/A | TAAGAATCATCTTACCAAAC | 35 | 7175 | 7194 | 1581 |
| 560799 | N/A | N/A | ATGTAAGAATCATCTTACCA | 52 | 7178 | 7197 | 65 |
| 560800 | N/A | N/A | AAGAATGTAAGAATCATCTT | 22 | 7182 | 7201 | 1582 |
| 560801 | N/A | N/A | GTTATTTAAGAATGTAAGAA | 0 | 7189 | 7208 | 1583 |
| 560802 | N/A | N/A | CGTGTTATTTAAGAATGTAA | 3 | 7192 | 7211 | 1584 |
| 560803 | N/A | N/A | AGCATTTTCTTAGATGGCG | 48 | 7210 | 7229 | 66 |
| 560804 | N/A | N/A | TAAAGCATTTTCTTAGATG | 0 | 7213 | 7232 | 1585 |
| 560805 | N/A | N/A | TGTTAAAGCATTTTCTTAG | 0 | 7216 | 7235 | 1586 |
| 560806 | N/A | N/A | TTTATGTTAAAGCATTTTTC | 20 | 7220 | 7239 | 1587 |
| 560807 | N/A | N/A | ATGTTTATGTTAAAGCATTT | 8 | 7223 | 7242 | 1588 |
| 560808 | N/A | N/A | GCATTTTTCAGTAATGTTT | 40 | 7237 | 7256 | 1589 |
| 560809 | N/A | N/A | TGTAGCATTTTTTCAGTAAT | 24 | 7241 | 7260 | 1590 |
| 560810 | N/A | N/A | CAAATGTAGCATTTTTTCAG | 0 | 7245 | 7264 | 1591 |
| 560811 | N/A | N/A | TGGCAAATGTAGCATTTTTT | 60 | 7248 | 7267 | 54 |
| 560812 | N/A | N/A | AAGTTGTGGCAAATGTAGCA | 26 | 7254 | 7273 | 1592 |
| 560813 | N/A | N/A | ATGAAGTTGTGGCAAATGTA | 11 | 7257 | 7276 | 1593 |
| 560814 | N/A | N/A | TTTATGAAGTTGTGGCAAAT | 36 | 7260 | 7279 | 1594 |
| 560815 | N/A | N/A | CATTTTATGAAGTTGTGGCA | 45 | 7263 | 7282 | 67 |
| 560816 | N/A | N/A | TGACATTTATGAAGTTGTG | 16 | 7266 | 7285 | 1595 |
| 560817 | N/A | N/A | CACTTGACATTTATGAAGT | 47 | 7270 | 7289 | 68 |
| 560818 | N/A | N/A | CTTGAGATTTCACTTGACAT | 18 | 7280 | 7299 | 1596 |
| 560819 | N/A | N/A | TTTGGAGCTTGAGATTTCAC | 0 | 7287 | 7306 | 1597 |
| 560820 | N/A | N/A | ATCTTTGGAGCTTGAGATTT | 0 | 7290 | 7309 | 1598 |
| 560821 | N/A | N/A | AATATCTTTGGAGCTTGAGA | 6 | 7293 | 7312 | 1599 |

TABLE 9-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560822 | N/A | N/A | AATAATATCTTTGGAGCTTG | 24 | 7296 | 7315 | 1600 |
| 560823 | N/A | N/A | AGGAATAATATCTTTGGAGC | 1 | 7299 | 7318 | 1601 |
| 560824 | N/A | N/A | AATAGGAATAATATCTTTGG | 0 | 7302 | 7321 | 1602 |
| 560825 | N/A | N/A | AGTAATAGGAATAATATCTT | 0 | 7305 | 7324 | 1603 |
| 560826 | N/A | N/A | TTACATCAGATTTAGTAATA | 0 | 7318 | 7337 | 1604 |
| 560827 | N/A | N/A | AAATGTTATTACATCAGATT | 0 | 7326 | 7345 | 1605 |
| 560828 | N/A | N/A | ATAAAATGTTATTACATCAG | 12 | 7329 | 7348 | 1606 |
| 560829 | N/A | N/A | CCTAGAATCAATAAAATGTT | 13 | 7339 | 7358 | 1607 |
| 560830 | N/A | N/A | AGGAATGCCTAGAATCAATA | 9 | 7346 | 7365 | 1608 |
| 560831 | N/A | N/A | ATTCAGCAGGAATGCCTAGA | 26 | 7353 | 7372 | 1609 |
| 560832 | N/A | N/A | TACATTCAGCAGGAATGCCT | 23 | 7356 | 7375 | 1610 |
| 560833 | N/A | N/A | TTACCTGATATAACATCACA | 30 | 7456 | 7475 | 1611 |
| 560834 | N/A | N/A | GTTTTACCTGATATAACATC | 6 | 7459 | 7478 | 1612 |
| 560835 | N/A | N/A | CAGGTTTTACCTGATATAAC | 4 | 7462 | 7481 | 1613 |
| 560836 | N/A | N/A | TTAGACAGGTTTTACCTGAT | 6 | 7467 | 7486 | 1614 |
| 560837 | N/A | N/A | ATTCTCCTTAGACAGGTTTT | 6 | 7474 | 7493 | 1615 |
| 560838 | N/A | N/A | ACTGTCTATTCTCCTTAGAC | 0 | 7481 | 7500 | 1616 |
| 560839 | N/A | N/A | ACTACTGTCTATTCTCCTTA | 17 | 7484 | 7503 | 1617 |
| 560840 | N/A | N/A | ACTAACTACTGTCTATTCTC | 0 | 7488 | 7507 | 1618 |
| 560841 | N/A | N/A | TGAACTAACTACTGTCTATT | 0 | 7491 | 7510 | 1619 |
| 560842 | N/A | N/A | AGTTGAACTAACTACTGTCT | 0 | 7494 | 7513 | 1620 |
| 560844 | N/A | N/A | ATTAATTGATATGTAAAACG | 0 | 8347 | 8366 | 1621 |
| 560845 | N/A | N/A | CCAATTAATTGATATGTAAA | 15 | 8350 | 8369 | 1622 |
| 560846 | N/A | N/A | TCCTTTTAACTTCCAATTAA | 29 | 8362 | 8381 | 1623 |
| 560847 | N/A | N/A | TCCTGGTCCTTTTAACTTCC | 58 | 8368 | 8387 | 69 |
| 560848 | N/A | N/A | GTTTCCTGGTCCTTTTAACT | 0 | 8371 | 8390 | 1624 |
| 560849 | N/A | N/A | TCTGAGTTTCCTGGTCCTTT | 36 | 8376 | 8395 | 1625 |
| 560850 | N/A | N/A | ATGTCTGAGTTTCCTGGTCC | 31 | 8379 | 8398 | 1626 |
| 560851 | N/A | N/A | TGTATGTCTGAGTTTCCTGG | 0 | 8382 | 8401 | 1627 |
| 560852 | N/A | N/A | ATGTATACTGTATGTCTGAG | 19 | 8390 | 8409 | 1628 |
| 560853 | N/A | N/A | AAAATGTATACTGTATGTCT | 12 | 8393 | 8412 | 1629 |
| 560854 | N/A | N/A | TTTTAAAATGTATACTGTAT | 0 | 8397 | 8416 | 1630 |
| 560855 | N/A | N/A | CATACATTCTATATATTATA | 29 | 8432 | 8451 | 1631 |
| 560856 | N/A | N/A | AAGCCATACATTCTATATAT | 38 | 8436 | 8455 | 55 |
| 560857 | N/A | N/A | ATTATAAGCCATACATTCTA | 6 | 8441 | 8460 | 1632 |
| 560858 | N/A | N/A | TTCATTATAAGCCATACATT | 0 | 8444 | 8463 | 1633 |

TABLE 9-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560859 | N/A | N/A | TAATTCATTATAAGCCATAC | 19 | 8447 | 8466 | 1634 |
| 560860 | N/A | N/A | TGAGTTAACTAATTCATTAT | 0 | 8456 | 8475 | 1635 |
| 560861 | N/A | N/A | TTTGCATTGAGTTAACTAAT | 26 | 8463 | 8482 | 1636 |
| 560862 | N/A | N/A | TAATTTGCATTGAGTTAACT | 0 | 8466 | 8485 | 1637 |
| 560863 | N/A | N/A | GAATAATTTGCATTGAGTTA | 0 | 8469 | 8488 | 1638 |
| 560864 | N/A | N/A | ATAGAATAATTTGCATTGAG | 0 | 8472 | 8491 | 1639 |
| 560865 | N/A | N/A | AAAATAGAATAATTTGCATT | 0 | 8475 | 8494 | 1640 |
| 560866 | N/A | N/A | TTGTAATCAAAATAGAATAA | 0 | 8483 | 8502 | 1641 |
| 560867 | N/A | N/A | TATTTGTAATCAAAATAGAA | 16 | 8486 | 8505 | 1642 |
| 560868 | N/A | N/A | TACTATTTGTAATCAAAATA | 0 | 8489 | 8508 | 1643 |
| 560869 | N/A | N/A | TTTTACTATTTGTAATCAAA | 0 | 8492 | 8511 | 1644 |
| 560870 | N/A | N/A | GCTTATTTTACTATTTGTAA | 0 | 8497 | 8516 | 1645 |
| 560871 | N/A | N/A | CTTGCTTATTTTACTATTTG | 0 | 8500 | 8519 | 1646 |
| 560872 | N/A | N/A | TTATCTTGCTTATTTTACTA | 1 | 8504 | 8523 | 1647 |
| 560873 | N/A | N/A | GTTATTTTATCTTGCTTATT | 0 | 8510 | 8529 | 1648 |
| 560874 | N/A | N/A | AAACATCTGTTATTTTATCT | 0 | 8518 | 8537 | 1649 |
| 560875 | N/A | N/A | GGATTTTAAACATCTGTTAT | 0 | 8525 | 8544 | 1650 |
| 560876 | N/A | N/A | CTTTTTGGATTTTAAACATC | 24 | 8531 | 8550 | 1651 |
| 560877 | N/A | N/A | GTGCTTTTTGGATTTTAAAC | 6 | 8534 | 8553 | 1652 |
| 560878 | N/A | N/A | TTTTGTATGTGCTTTTTGGA | 24 | 8542 | 8561 | 1653 |
| 560879 | N/A | N/A | GACATCATTCATGGATTTTT | 50 | 8558 | 8577 | 70 |
| 560880 | N/A | N/A | AGTACTTAGACATCATTCAT | 43 | 8566 | 8585 | 71 |
| 560881 | N/A | N/A | TAAGTGAGTACTTAGACATC | 17 | 8572 | 8591 | 1654 |
| 560882 | N/A | N/A | TACTTTATAAGTGAGTACTT | 0 | 8579 | 8598 | 1655 |
| 560883 | N/A | N/A | TTCTACTTTATAAGTGAGTA | 32 | 8582 | 8601 | 1656 |
| 560884 | N/A | N/A | AATGTCTTCTACTTTATAAG | 0 | 8588 | 8607 | 1657 |
| 560885 | N/A | N/A | AATAATGAATGTCTTCTACT | 9 | 8595 | 8614 | 1658 |
| 560886 | N/A | N/A | TATAATAATGAATGTCTTCT | 0 | 8598 | 8617 | 1659 |
| 560887 | N/A | N/A | TGATATAATAATGAATGTCT | 29 | 8601 | 8620 | 1660 |
| 560888 | N/A | N/A | AAAATTTGATATAATAATGA | 0 | 8607 | 8626 | 1661 |
| 560889 | N/A | N/A | CATTTAAAAATTTGATATAA | 0 | 8613 | 8632 | 1662 |
| 560890 | N/A | N/A | GTACTGAGCATTTAAAAATT | 8 | 8621 | 8640 | 1663 |
| 560891 | N/A | N/A | GGTCAAATAGTACTGAGCAT | 40 | 8630 | 8649 | 72 |
| 560892 | N/A | N/A | AATGGTCAAATAGTACTGAG | 23 | 8633 | 8652 | 1664 |
| 560893 | N/A | N/A | TTAAATGGTCAAATAGTACT | 17 | 8636 | 8655 | 1665 |

TABLE 9-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560894 | N/A | N/A | AGTTTGAATACAAAATTTTT | 0 | 8654 | 8673 | 1666 |
| 560895 | N/A | N/A | GGTAGTTTGAATACAAAATT | 38 | 8657 | 8676 | 73 |
| 560896 | N/A | N/A | ACTGGTAGTTTGAATACAAA | 0 | 8660 | 8679 | 1667 |
| 560897 | N/A | N/A | TTCACTGGTAGTTTGAATAC | 0 | 8663 | 8682 | 1668 |
| 560898 | N/A | N/A | GCTTTCACTGGTAGTTTGAA | 25 | 8666 | 8685 | 1669 |
| 560899 | N/A | N/A | AGGGCTTTCACTGGTAGTTT | 30 | 8669 | 8688 | 1670 |
| 560900 | N/A | N/A | GGTAGGGCTTTCACTGGTAG | 9 | 8672 | 8691 | 1671 |
| 560901 | N/A | N/A | CTAGGTAGGGCTTTCACTGG | 37 | 8675 | 8694 | 1672 |
| 560902 | N/A | N/A | CTTCTAGGTAGGGCTTTCAC | 32 | 8678 | 8697 | 1673 |
| 560903 | N/A | N/A | TACCTTCTAGGTAGGGCTTT | 26 | 8681 | 8700 | 1674 |
| 560904 | N/A | N/A | GTATACCTTCTAGGTAGGGC | 0 | 8684 | 8703 | 1675 |
| 560905 | N/A | N/A | TGAGTATACCTTCTAGGTAG | 15 | 8687 | 8706 | 1676 |
| 560906 | N/A | N/A | CACTGAGTATACCTTCTAGG | 36 | 8690 | 8709 | 1677 |
| 560907 | N/A | N/A | TATCACTGAGTATACCTTCT | 0 | 8693 | 8712 | 1678 |
| 560908 | N/A | N/A | ACTTATCACTGAGTATACCT | 28 | 8696 | 8715 | 1679 |
| 560909 | N/A | N/A | ACAAAACTTATCACTGAGTA | 32 | 8701 | 8720 | 1680 |
| 560910 | N/A | N/A | GCTACAAAACTTATCACTGA | 15 | 8704 | 8723 | 1681 |
| 560911 | N/A | N/A | GGAGCTACAAAACTTATCAC | 21 | 8707 | 8726 | 1682 |
| 560912 | N/A | N/A | GATTTGGAGCTACAAAACTT | 0 | 8712 | 8731 | 1683 |
| 560913 | N/A | N/A | GAAGATTTGGAGCTACAAAA | 0 | 8715 | 8734 | 1684 |
| 560914 | N/A | N/A | CTATTAGAAGATTTGGAGCT | 0 | 8721 | 8740 | 1685 |
| 560915 | N/A | N/A | CACTCACTATTAGAAGATTT | 33 | 8727 | 8746 | 1686 |
| 560916 | N/A | N/A | TGTCAGCCTTTTATTTGGG | 0 | 8751 | 8770 | 1687 |
| 560917 | N/A | N/A | ACCTGTCAGCCTTTTATTTT | 11 | 8754 | 8773 | 1688 |
| 560918 | N/A | N/A | TCGACTTACCTGTCAGCCTT | 0 | 8761 | 8780 | 1689 |
| 560919 | N/A | N/A | TTCTCGACTTACCTGTCAGC | 0 | 8764 | 8783 | 1690 |
| 560920 | N/A | N/A | GTATTCTCGACTTACCTGTC | 0 | 8767 | 8786 | 1691 |
| 560921 | N/A | N/A | TAACATCCATATACAGTCAA | 25 | 9177 | 9196 | 1692 |
| 560922 | N/A | N/A | TATTAACATCCATATACAGT | 20 | 9180 | 9199 | 1693 |
| 560923 | N/A | N/A | ATTTATTAACATCCATATAC | 20 | 9183 | 9202 | 1694 |
| 560924 | N/A | N/A | GCTATTTATTAACATCCATA | 47 | 9186 | 9205 | 1695 |
| 560925 | N/A | N/A | TCAGCTATTTATTAACATCC | 58 | 9189 | 9208 | 56 |
| 560926 | N/A | N/A | CTGTCAGCTATTTATTAACA | 30 | 9192 | 9211 | 1696 |
| 560927 | N/A | N/A | TTACTGTCAGCTATTTATTA | 22 | 9195 | 9214 | 1697 |
| 560928 | N/A | N/A | ACTTTACTGTCAGCTATTTA | 27 | 9198 | 9217 | 1698 |
| 560929 | N/A | N/A | TAAACTTTACTGTCAGCTAT | 41 | 9201 | 9220 | 1699 |

TABLE 9-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560930 | N/A | N/A | GGATAAACTTTACTGTCAGC | 45 | 9204 | 9223 | 1700 |
| 560931 | N/A | N/A | TATGGATAAACTTTACTGTC | 15 | 9207 | 9226 | 1701 |
| 560932 | N/A | N/A | TTATATGGATAAACTTTACT | 0 | 9210 | 9229 | 1702 |
| 560933 | N/A | N/A | TTGCAAGTCTTTATATGGAT | 47 | 9220 | 9239 | 1703 |
| 560934 | N/A | N/A | TATTTGCAAGTCTTTATATG | 26 | 9223 | 9242 | 1704 |
| 560935 | N/A | N/A | GAATATTTGCAAGTCTTTAT | 4 | 9226 | 9245 | 1705 |
| 560936 | N/A | N/A | GAGGAATATTTGCAAGTCTT | 58 | 9229 | 9248 | 57 |
| 560937 | N/A | N/A | GTAGAGGAATATTTGCAAGT | 47 | 9232 | 9251 | 1706 |
| 560938 | N/A | N/A | TTGGTAGAGGAATATTTGCA | 65 | 9235 | 9254 | 58 |
| 560939 | N/A | N/A | GTTACATTATTATAGATATT | 33 | 9269 | 9288 | 1707 |
| 560940 | N/A | N/A | TGTGTTACATTATTATAGAT | 20 | 9272 | 9291 | 1708 |
| 560941 | N/A | N/A | GAAATGTGTTACATTATTAT | 0 | 9276 | 9295 | 1709 |
| 560942 | N/A | N/A | ACCAGTGAAATGTGTTACAT | 56 | 9282 | 9301 | 59 |
| 560943 | N/A | N/A | TTCACCAGTGAAATGTGTTA | 19 | 9285 | 9304 | 1710 |
| 560944 | N/A | N/A | TGTTTCACCAGTGAAATGTG | 41 | 9288 | 9307 | 1711 |
| 560945 | N/A | N/A | ACATGTTTCACCAGTGAAAT | 0 | 9291 | 9310 | 1712 |
| 560946 | N/A | N/A | AAGACATGTTTCACCAGTGA | 48 | 9294 | 9313 | 1713 |
| 560947 | N/A | N/A | GACAAGACATGTTTCACCAG | 28 | 9297 | 9316 | 1714 |
| 560948 | N/A | N/A | TATGACAAGACATGTTTCAC | 13 | 9300 | 9319 | 1715 |
| 560949 | N/A | N/A | GCATATGACAAGACATGTTT | 12 | 9303 | 9322 | 1716 |
| 560950 | N/A | N/A | TAATGCATATGACAAGACAT | 4 | 9307 | 9326 | 1717 |
| 560951 | N/A | N/A | CTATAATGCATATGACAAGA | 22 | 9310 | 9329 | 1718 |
| 560952 | N/A | N/A | TTTCTATAATGCATATGACA | 23 | 9313 | 9332 | 1719 |
| 560953 | N/A | N/A | TCCTTTCTATAATGCATATG | 16 | 9316 | 9335 | 1720 |
| 560954 | N/A | N/A | TCTGATTATCCTTTCTATAA | 32 | 9324 | 9343 | 1721 |
| 560955 | N/A | N/A | AAGTCTGATTATCCTTTCTA | 42 | 9327 | 9346 | 1722 |
| 560956 | N/A | N/A | TGAAAGTCTGATTATCCTTT | 51 | 9330 | 9349 | 60 |
| 560957 | N/A | N/A | AACTGAAAGTCTGATTATCC | 31 | 9333 | 9352 | 1723 |
| 560958 | N/A | N/A | TATAACTGAAAGTCTGATTA | 6 | 9336 | 9355 | 1724 |
| 560959 | N/A | N/A | GTTAAAAATATTAATATAAC | 3 | 9350 | 9369 | 1725 |
| 560960 | N/A | N/A | TGTGCACAAAAATGTTAAAA | 0 | 9363 | 9382 | 1726 |
| 560961 | N/A | N/A | CTATGTGCACAAAAATGTTA | 9 | 9366 | 9385 | 1727 |
| 560962 | N/A | N/A | TAGCTATGTGCACAAAAATG | 29 | 9369 | 9388 | 1728 |
| 560963 | N/A | N/A | AGATAGCTATGTGCACAAAA | 41 | 9372 | 9391 | 1729 |
| 560964 | N/A | N/A | TGAAGATAGCTATGTGCACA | 23 | 9375 | 9394 | 1730 |

TABLE 9-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560965 | N/A | N/A | TATTGAAGATAGCTATGTGC | 13 | 9378 | 9397 | 1731 |
| 560966 | N/A | N/A | TTTTATTGAAGATAGCTATG | 4 | 9381 | 9400 | 1732 |
| 560967 | N/A | N/A | CAATTTTATTGAAGATAGCT | 17 | 9384 | 9403 | 1733 |
| 560968 | N/A | N/A | AAACAATTTTATTGAAGATA | 27 | 9387 | 9406 | 1734 |
| 560969 | N/A | N/A | GTGTATCTTAAAATAATACC | 7 | 9412 | 9431 | 1735 |
| 560970 | N/A | N/A | TTAGTGTATCTTAAAATAAT | 25 | 9415 | 9434 | 1736 |
| 560971 | N/A | N/A | TGATCATTTTAGTGTATCTT | 34 | 9423 | 9442 | 1737 |
| 560972 | N/A | N/A | CCCTTGATCATTTTAGTGTA | 7 | 9427 | 9446 | 1738 |
| 560973 | N/A | N/A | AATCCCTTGATCATTTTAGT | 0 | 9430 | 9449 | 1739 |
| 560974 | N/A | N/A | TTGAATCCCTTGATCATTTT | 20 | 9433 | 9452 | 1740 |
| 560975 | N/A | N/A | TTAGTCTTGAATCCCTTGAT | 28 | 9439 | 9458 | 1741 |
| 560976 | N/A | N/A | TTGTTTAGTCTTGAATCCCT | 40 | 9443 | 9462 | 1742 |
| 560977 | N/A | N/A | GAGTTGTTTAGTCTTGAATC | 6 | 9446 | 9465 | 1743 |
| 560978 | N/A | N/A | ATTGAGTTGTTTAGTCTTGA | 14 | 9449 | 9468 | 1744 |
| 560979 | N/A | N/A | CTAATTGAGTTGTTTAGTCT | 0 | 9452 | 9471 | 1745 |
| 560980 | N/A | N/A | CAACTAATTGAGTTGTTTAG | 0 | 9455 | 9474 | 1746 |
| 560981 | N/A | N/A | ATTGGTGCAACTAATTGAGT | 0 | 9462 | 9481 | 1747 |
| 560982 | N/A | N/A | TTTATTGGTGCAACTAATTG | 9 | 9465 | 9484 | 1748 |
| 560983 | N/A | N/A | TTTTTTATTGGTGCAACTAA | 8 | 9468 | 9487 | 1749 |
| 560984 | N/A | N/A | TAAGTGTTTTTATTGGTGC | 20 | 9474 | 9493 | 1750 |
| 560985 | N/A | N/A | ACTGACAGTTTTTTAAGTG | 16 | 9488 | 9507 | 1751 |
| 560986 | N/A | N/A | GACACTGACAGTTTTTTAA | 6 | 9491 | 9510 | 1752 |
| 560987 | N/A | N/A | TTGGACACTGACAGTTTTTT | 0 | 9494 | 9513 | 1753 |
| 560988 | N/A | N/A | AGGTTGGACACTGACAGTTT | 6 | 9497 | 9516 | 1754 |
| 560989 | N/A | N/A | TACAGGTTGGACACTGACAG | 0 | 9500 | 9519 | 1755 |
| 544120 | 707 | 726 | AGTTCTTGGTGCTCTTGGCT | 72 | 6720 | 6739 | 15 |
| 337487 | 804 | 823 | CACTTGTATGTTCACCTCTG | 80 | 7389 | 7408 | 28 |
| 544145 | 1055 | 1074 | GTTGTCTTTCCAGTCTTCCA | 69 | 9630 | 9649 | 16 |
| 544156 | 1195 | 1214 | GCTTTGTGATCCCAAGTAGA | 61 | 9770 | 9789 | 17 |
| 544162 | 1269 | 1288 | GGTTGTTTTCTCCACACTCA | 71 | 10241 | 10260 | 18 |
| 544166 | 1353 | 1372 | ACCTTCCATTTGAGACTTC | 65 | 10325 | 10344 | 19 |
| 544199 | 1907 | 1926 | TACACATACTCTGTGCTGAC | 69 | 10879 | 10898 | 20 |

TABLE 10

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 563720 | N/A | N/A | TATATTGGATAATTTGAAAT | 7 | 11610 | 11629 | 1756 |
| 563721 | N/A | N/A | ATGTATATTGGATAATTTGA | 17 | 11613 | 11632 | 1757 |
| 563722 | N/A | N/A | GACATGTATATTGGATAATT | 20 | 11616 | 11635 | 1758 |
| 563723 | N/A | N/A | ATGACATGTATATTGGATAA | 29 | 11618 | 11637 | 1759 |
| 563724 | N/A | N/A | TATATATGACATGTATATTG | 9 | 11623 | 11642 | 1760 |
| 563725 | N/A | N/A | ATGTGACATATAAAAATATA | 4 | 11639 | 11658 | 1761 |
| 563726 | N/A | N/A | ATATGTGACATATAAAAATA | 0 | 11641 | 11660 | 1762 |
| 563727 | N/A | N/A | TTTATATATGTGACATATAA | 0 | 11646 | 11665 | 1763 |
| 563728 | N/A | N/A | CTTTTATATATGTGACATAT | 16 | 11648 | 11667 | 1764 |
| 563729 | N/A | N/A | ATCTTTTATATATGTGACAT | 13 | 11650 | 11669 | 1765 |
| 563730 | N/A | N/A | CATATCTTTTATATATGTGA | 2 | 11653 | 11672 | 1766 |
| 563731 | N/A | N/A | TCATACATATCTTTTATATA | 2 | 11658 | 11677 | 1767 |
| 563732 | N/A | N/A | TAGATCATACATATCTTTTA | 31 | 11662 | 11681 | 1768 |
| 563733 | N/A | N/A | CATAGATCATACATATCTTT | 28 | 11664 | 11683 | 1769 |
| 563734 | N/A | N/A | CACATAGATCATACATATCT | 56 | 11666 | 11685 | 1770 |
| 563735 | N/A | N/A | AGGATTCACATAGATCATAC | 56 | 11672 | 11691 | 1771 |
| 563736 | N/A | N/A | TTAGGATTCACATAGATCAT | 24 | 11674 | 11693 | 1772 |
| 563737 | N/A | N/A | ACTTAGGATTCACATAGATC | 49 | 11676 | 11695 | 1773 |
| 563738 | N/A | N/A | TTACTTAGGATTCACATAGA | 15 | 11678 | 11697 | 1774 |
| 563739 | N/A | N/A | TATTTACTTAGGATTCACAT | 6 | 11681 | 11700 | 1775 |
| 563740 | N/A | N/A | AATATTTACTTAGGATTCAC | 28 | 11683 | 11702 | 1776 |
| 563741 | N/A | N/A | TGTACTTTTCTGGAACAAAA | 63 | 11701 | 11720 | 1777 |
| 563742 | N/A | N/A | GATTATTTTTACCTTTATTA | 21 | 11724 | 11743 | 1778 |
| 563743 | N/A | N/A | TAGATTATTTTTACCTTTAT | 5 | 11726 | 11745 | 1779 |
| 563744 | N/A | N/A | ATTATAGATTATTTTTACCT | 12 | 11730 | 11749 | 1780 |
| 563745 | N/A | N/A | GAAAATTATAGATTATTTTT | 15 | 11734 | 11753 | 1781 |
| 563746 | N/A | N/A | GGTCCTGAAAATTATAGATT | 7 | 11740 | 11759 | 1782 |
| 563747 | N/A | N/A | GTGGTCCTGAAAATTATAGA | 29 | 11742 | 11761 | 1783 |
| 563748 | N/A | N/A | CTGTGGTCCTGAAAATTATA | 37 | 11744 | 11763 | 1784 |
| 563749 | N/A | N/A | GTCTGTGGTCCTGAAAATTA | 47 | 11746 | 11765 | 1785 |
| 563750 | N/A | N/A | TCGACAGCTTAGTCTGTGGT | 66 | 11757 | 11776 | 1786 |
| 563751 | N/A | N/A | TTTCGACAGCTTAGTCTGTG | 41 | 11759 | 11778 | 1787 |
| 563752 | N/A | N/A | AATTTCGACAGCTTAGTCTG | 40 | 11761 | 11780 | 1788 |
| 563753 | N/A | N/A | TTAATTTCGACAGCTTAGTC | 35 | 11763 | 11782 | 1789 |
| 563754 | N/A | N/A | CGTTAATTTCGACAGCTTAG | 50 | 11765 | 11784 | 1790 |
| 563755 | N/A | N/A | TGGCCCTAAAAAAATCAGCG | 7 | 11783 | 11802 | 1791 |

TABLE 10-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 563756 | N/A | N/A | TCTGGCCCTAAAAAATCAG | 0 | 11785 | 11804 | 1792 |
| 563757 | N/A | N/A | TGGTATTCTGGCCCTAAAAA | 37 | 11791 | 11810 | 1793 |
| 563758 | N/A | N/A | TTTGGTATTCTGGCCCTAAA | 29 | 11793 | 11812 | 1794 |
| 563759 | N/A | N/A | CCATTTTGGTATTCTGGCCC | 35 | 11797 | 11816 | 1795 |
| 563760 | N/A | N/A | GAGGAGCCATTTTGGTATTC | 34 | 11803 | 11822 | 1796 |
| 563761 | N/A | N/A | GAGAGGAGCCATTTTGGTAT | 18 | 11805 | 11824 | 1797 |
| 563762 | N/A | N/A | AAGAGAGGAGCCATTTTGGT | 17 | 11807 | 11826 | 1798 |
| 563763 | N/A | N/A | TGAAATTGTCCAATTTTGGG | 28 | 11829 | 11848 | 1799 |
| 563764 | N/A | N/A | TTTGAAATTGTCCAATTTTG | 10 | 11831 | 11850 | 1800 |
| 563765 | N/A | N/A | CATTTGAAATTGTCCAATTT | 22 | 11833 | 11852 | 1801 |
| 563766 | N/A | N/A | TGCATTTGAAATTGTCCAAT | 45 | 11835 | 11854 | 1802 |
| 563767 | N/A | N/A | ATTTTGCATTTGAAATTGTC | 35 | 11839 | 11858 | 1803 |
| 563768 | N/A | N/A | ATAATGAATTATTTTGCATT | 0 | 11849 | 11868 | 1804 |
| 563769 | N/A | N/A | TAAATAATGAATTATTTTGC | 17 | 11852 | 11871 | 1805 |
| 563770 | N/A | N/A | CTCATATATTAAATAATGAA | 0 | 11861 | 11880 | 1806 |
| 563771 | N/A | N/A | AACTCATATATTAAATAATG | 16 | 11863 | 11882 | 1807 |
| 563772 | N/A | N/A | TAGAGGAAGCAACTCATATA | 7 | 11873 | 11892 | 1808 |
| 563773 | N/A | N/A | AATAGAGGAAGCAACTCATA | 20 | 11875 | 11894 | 1809 |
| 563774 | N/A | N/A | CAAATAGAGGAAGCAACTCA | 29 | 11877 | 11896 | 1810 |
| 563775 | N/A | N/A | ACCAAATAGAGGAAGCAACT | 27 | 11879 | 11898 | 1811 |
| 563776 | N/A | N/A | AAACCAAATAGAGGAAGCAA | 22 | 11881 | 11900 | 1812 |
| 563777 | N/A | N/A | GGAAACCAAATAGAGGAAGC | 37 | 11883 | 11902 | 1813 |
| 563778 | N/A | N/A | TAAGGAAACCAAATAGAGGA | 0 | 11886 | 11905 | 1814 |
| 563779 | N/A | N/A | TTTAAGGAAACCAAATAGAG | 0 | 11888 | 11907 | 1815 |
| 563780 | N/A | N/A | TGTTTTCTTCTGGAAGCAGA | 5 | 3100 | 3119 | 1816 |
| 563781 | N/A | N/A | CTTACTTTAAGTGAAGTTAC | 0 | 3636 | 3655 | 1817 |
| 563782 | N/A | N/A | TTTTCTACTTACTTTAAGTG | 3 | 3643 | 3662 | 1818 |
| 563783 | N/A | N/A | ACATGAACCCTCTTTATTTT | 0 | 3659 | 3678 | 1819 |
| 563784 | N/A | N/A | GAAAACATAAACATGAACCC | 0 | 3669 | 3688 | 1820 |
| 563785 | N/A | N/A | AGATCCACATTGAAAACATA | 8 | 3680 | 3699 | 1821 |
| 563786 | N/A | N/A | TTAAAAGATCCACATTGAAA | 8 | 3685 | 3704 | 1822 |
| 563787 | N/A | N/A | GCCTTAGAAATATTTTTTTT | 2 | 3703 | 3722 | 1823 |
| 563788 | N/A | N/A | CAAATGGCATGCCTTAGAAA | 29 | 3713 | 3732 | 1824 |
| 563789 | N/A | N/A | TATTTCAAATGGCATGCCTT | 24 | 3718 | 3737 | 1825 |
| 563790 | N/A | N/A | CAAAGTATTTCAAATGGCAT | 8 | 3723 | 3742 | 1826 |

TABLE 10-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 563791 | N/A | N/A | TGCAACAAAGTATTTCAAAT | 0 | 3728 | 3747 | 1827 |
| 563792 | N/A | N/A | TCAACAATGCAACAAAGTAT | 3 | 3735 | 3754 | 1828 |
| 563793 | N/A | N/A | GAAAAAAAGTATTTCAACA | 4 | 3749 | 3768 | 1829 |
| 563794 | N/A | N/A | GATTATTTTCTTGGAAAAA | 11 | 3763 | 3782 | 1830 |
| 563795 | N/A | N/A | GAAATTTATTTTCTGGAGA | 10 | 3781 | 3800 | 1831 |
| 563796 | N/A | N/A | AAATTATAATAGGAAATTTT | 14 | 3793 | 3812 | 1832 |
| 563797 | N/A | N/A | CTGAATATAATGAATGAAAT | 1 | 7854 | 7873 | 1833 |
| 563798 | N/A | N/A | TACCTGAATATAATGAATGA | 4 | 7857 | 7876 | 1834 |
| 563799 | N/A | N/A | GACTACCTGAATATAATGAA | 25 | 7860 | 7879 | 1835 |
| 563800 | N/A | N/A | ATGGACTACCTGAATATAAT | 15 | 7863 | 7882 | 1836 |
| 563801 | N/A | N/A | TCCATGGACTACCTGAATAT | 39 | 7866 | 7885 | 1837 |
| 563802 | N/A | N/A | ACCATCAAGCCTCCCAAAAC | 23 | 7952 | 7971 | 1838 |
| 563803 | N/A | N/A | CCTTACCATCAAGCCTCCCA | 29 | 7956 | 7975 | 1839 |
| 563804 | N/A | N/A | AGTCCCCTTACCATCAAGCC | 31 | 7961 | 7980 | 1840 |
| 563805 | N/A | N/A | TGTAGTCCCCTTACCATCAA | 18 | 7964 | 7983 | 1841 |
| 563806 | N/A | N/A | GAATGTAGTCCCCTTACCAT | 0 | 7967 | 7986 | 1842 |
| 563807 | N/A | N/A | ATTGAATGTAGTCCCCTTAC | 12 | 7970 | 7989 | 1843 |
| 563808 | N/A | N/A | ATGATTGAATGTAGTCCCCT | 14 | 7973 | 7992 | 1844 |
| 563809 | N/A | N/A | GATTAGCAAGTGAATGAATG | 13 | 7990 | 8009 | 1845 |
| 563810 | N/A | N/A | GTAGATTAGCAAGTGAATGA | 25 | 7993 | 8012 | 1846 |
| 563811 | N/A | N/A | TTTGTAGATTAGCAAGTGAA | 9 | 7996 | 8015 | 1847 |
| 563812 | N/A | N/A | ATATTTGTAGATTAGCAAGT | 0 | 7999 | 8018 | 1848 |
| 563813 | N/A | N/A | CCATAAGAGGTTCTCAGTAA | 44 | 8019 | 8038 | 1849 |
| 563814 | N/A | N/A | GGTCCATAAGAGGTTCTCAG | 37 | 8022 | 8041 | 1850 |
| 563815 | N/A | N/A | CCTGGTCCATAAGAGGTTCT | 25 | 8025 | 8044 | 1851 |
| 563816 | N/A | N/A | TAATACCTGGTCCATAAGAG | 9 | 8030 | 8049 | 1852 |
| 563817 | N/A | N/A | TCCTAATACCTGGTCCATAA | 39 | 8033 | 8052 | 1853 |
| 563818 | N/A | N/A | TTTTCCTAATACCTGGTCCA | 43 | 8036 | 8055 | 1854 |
| 563819 | N/A | N/A | TACTTTTCCTAATACCTGGT | 43 | 8039 | 8058 | 1855 |
| 563820 | N/A | N/A | CGTTACTACTTTTCCTAATA | 47 | 8045 | 8064 | 1856 |
| 563821 | N/A | N/A | AAGGCTGAGACTGCTTCTCG | 46 | 8067 | 8086 | 1857 |
| 563822 | N/A | N/A | GATAATAAATTATATGAAGG | 5 | 8083 | 8102 | 1858 |
| 563823 | N/A | N/A | GTTTGATAATAAATTATATG | 0 | 8087 | 8106 | 1859 |
| 563824 | N/A | N/A | GTGTAATTGTTTGATAATAA | 14 | 8095 | 8114 | 1860 |
| 563825 | N/A | N/A | AATGTGTAATTGTTTGATAA | 0 | 8098 | 8117 | 1861 |
| 563826 | N/A | N/A | GTAATTTACTAACAAATGTG | 18 | 8112 | 8131 | 1862 |

TABLE 10-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 563827 | N/A | N/A | AGTGTAATTTACTAACAAAT | 0 | 8115 | 8134 | 1863 |
| 563828 | N/A | N/A | ATAAGTGTAATTTACTAACA | 0 | 8118 | 8137 | 1864 |
| 563829 | N/A | N/A | GTAATAAGTGTAATTTACTA | 0 | 8121 | 8140 | 1865 |
| 563830 | N/A | N/A | GTTGTAATAAGTGTAATTTA | 20 | 8124 | 8143 | 1866 |
| 563831 | N/A | N/A | ACAGTTGTAATAAGTGTAAT | 1 | 8127 | 8146 | 1867 |
| 563832 | N/A | N/A | ATAACAGTTGTAATAAGTGT | 4 | 8130 | 8149 | 1868 |
| 563833 | N/A | N/A | TTCAAATAATAACAGTTGTA | 0 | 8138 | 8157 | 1869 |
| 563834 | N/A | N/A | ATAATTCAAATAATAACAGT | 16 | 8142 | 8161 | 1870 |
| 563835 | N/A | N/A | AATTGTGATAAATATAATTC | 0 | 8155 | 8174 | 1871 |
| 563836 | N/A | N/A | ATGTAATTGTGATAAATATA | 0 | 8159 | 8178 | 1872 |
| 563837 | N/A | N/A | GACATGTAATTGTGATAAAT | 8 | 8162 | 8181 | 1873 |
| 563838 | N/A | N/A | ACAGACATGTAATTGTGATA | 33 | 8165 | 8184 | 1874 |
| 563839 | N/A | N/A | AGAACAGACATGTAATTGTG | 34 | 8168 | 8187 | 1875 |
| 563840 | N/A | N/A | TTAAGAACAGACATGTAATT | 0 | 8171 | 8190 | 1876 |
| 563841 | N/A | N/A | AAGTATATTTAAGAACAGAC | 0 | 8179 | 8198 | 1877 |
| 563842 | N/A | N/A | TTAAATTGTGATAAGTATAT | 1 | 8191 | 8210 | 1878 |
| 563843 | N/A | N/A | GAATTAAATTGTGATAAGTA | 0 | 8194 | 8213 | 1879 |
| 563844 | N/A | N/A | GTGGAATTAAATTGTGATAA | 0 | 8197 | 8216 | 1880 |
| 563845 | N/A | N/A | GCCGTGGAATTAAATTGTGA | 20 | 8200 | 8219 | 1881 |
| 563846 | N/A | N/A | TAAGCCGTGGAATTAAATTG | 16 | 8203 | 8222 | 1882 |
| 563847 | N/A | N/A | TTGTAAGCCGTGGAATTAAA | 28 | 8206 | 8225 | 1883 |
| 563848 | N/A | N/A | TCATTGTAAGCCGTGGAATT | 25 | 8209 | 8228 | 1884 |
| 563849 | N/A | N/A | TGATCATTGTAAGCCGTGGA | 49 | 8212 | 8231 | 1885 |
| 563850 | N/A | N/A | TATAGTTATGATCATTGTAA | 0 | 8220 | 8239 | 1886 |
| 563851 | N/A | N/A | AATTATAGTTATGATCATTG | 0 | 8223 | 8242 | 1887 |
| 563852 | N/A | N/A | CTTTAATAATTATAGTTATG | 0 | 8230 | 8249 | 1888 |
| 563853 | N/A | N/A | TGTCTTTAATAATTATAGTT | 4 | 8233 | 8252 | 1889 |
| 563854 | N/A | N/A | AATTGTCTTTAATAATTATA | 0 | 8236 | 8255 | 1890 |
| 563855 | N/A | N/A | TCAAAATTGTCTTTAATAAT | 7 | 8240 | 8259 | 1891 |
| 563856 | N/A | N/A | ATTTAATCAAAATTGTCTTT | 0 | 8246 | 8265 | 1892 |
| 563857 | N/A | N/A | TAACATTTAATCAAAATTGT | 0 | 8250 | 8269 | 1893 |
| 563858 | N/A | N/A | ACATAACATTTAATCAAAAT | 0 | 8253 | 8272 | 1894 |
| 563859 | N/A | N/A | ATGACATAACATTTAATCAA | 13 | 8256 | 8275 | 1895 |
| 563860 | N/A | N/A | TACTTATGACATAACATTTA | 0 | 8261 | 8280 | 1896 |
| 563861 | N/A | N/A | TTACTACTTATGACATAACA | 0 | 8265 | 8284 | 1897 |

TABLE 10-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 563862 | N/A | N/A | AACAGTTACTACTTATGACA | 31 | 8270 | 8289 | 1898 |
| 563863 | N/A | N/A | TGTAACAGTTACTACTTATG | 29 | 8273 | 8292 | 1899 |
| 563864 | N/A | N/A | CTTATTTGTAACAGTTACTA | 0 | 8279 | 8298 | 1900 |
| 563865 | N/A | N/A | TTTCACAGCTTATTTGTAAC | 29 | 8287 | 8306 | 1901 |
| 563866 | N/A | N/A | TCTTTTCACAGCTTATTTGT | 22 | 8290 | 8309 | 1902 |
| 563867 | N/A | N/A | GGTTCTTTTCACAGCTTATT | 66 | 8293 | 8312 | 1903 |
| 563868 | N/A | N/A | CTAGGAGTGGTTCTTTTCAC | 37 | 8301 | 8320 | 1904 |
| 563869 | N/A | N/A | ATGCTAGGAGTGGTTCTTTT | 20 | 8304 | 8323 | 1905 |
| 563870 | N/A | N/A | CTAATGCTAGGAGTGGTTCT | 30 | 8307 | 8326 | 1906 |
| 563871 | N/A | N/A | AGAGTGACTAATGCTAGGAG | 41 | 8314 | 8333 | 1907 |
| 563872 | N/A | N/A | AGAGAATAGAGTGACTAATG | 28 | 8321 | 8340 | 1908 |
| 563873 | N/A | N/A | TTAATGAGAGAATAGAGTGA | 4 | 8327 | 8346 | 1909 |
| 563496 | 608 | 627 | CTGTTGGTTTAATTGTTTAT | 33 | 4346 | 4365 | 1910 |
| 563497 | 610 | 629 | TGCTGTTGGTTTAATTGTTT | 29 | 4348 | 4367 | 1911 |
| 563498 | 612 | 631 | TATGCTGTTGGTTTAATTGT | 27 | 4350 | 4369 | 1912 |
| 563499 | 614 | 633 | ACTATGCTGTTGGTTTAATT | 24 | 4352 | 4371 | 1913 |
| 563500 | 616 | 635 | TGACTATGCTGTTGGTTTAA | 68 | 4354 | 4373 | 1914 |
| 563501 | 619 | 638 | ATTTGACTATGCTGTTGGTT | 45 | 4357 | 4376 | 1915 |
| 563502 | 621 | 640 | TTATTTGACTATGCTGTTGG | 39 | 4359 | 4378 | 1916 |
| 563503 | 623 | 642 | TTTTATTTGACTATGCTGTT | 33 | 4361 | 4380 | 1917 |
| 563504 | 625 | 644 | TCTTTTATTTGACTATGCTG | 55 | 4363 | 4382 | 1918 |
| 563505 | 627 | 646 | TTTCTTTTATTTGACTATGC | 29 | 4365 | 4384 | 1919 |
| 563506 | 646 | 665 | CTTCTGAGCTGATTTTCTAT | 40 | N/A | N/A | 1920 |
| 563507 | 648 | 667 | TCCTTCTGAGCTGATTTTCT | 76 | N/A | N/A | 1921 |
| 563508 | 650 | 669 | AGTCCTTCTGAGCTGATTTT | 37 | N/A | N/A | 1922 |
| 563509 | 652 | 671 | CTAGTCCTTCTGAGCTGATT | 52 | N/A | N/A | 1923 |
| 563510 | 654 | 673 | TACTAGTCCTTCTGAGCTGA | 52 | 6667 | 6686 | 1924 |
| 563511 | 656 | 675 | AATACTAGTCCTTCTGAGCT | 41 | 6669 | 6688 | 1925 |
| 563512 | 658 | 677 | TGAATACTAGTCCTTCTGAG | 55 | 6671 | 6690 | 1926 |
| 563513 | 660 | 679 | CTTGAATACTAGTCCTTCTG | 43 | 6673 | 6692 | 1927 |
| 563514 | 662 | 681 | TTCTTGAATACTAGTCCTTC | 34 | 6675 | 6694 | 1928 |
| 563515 | 666 | 685 | TGGGTTCTTGAATACTAGTC | 52 | 6679 | 6698 | 1929 |
| 563516 | 668 | 687 | TGTGGGTTCTTGAATACTAG | 34 | 6681 | 6700 | 1930 |
| 563517 | 670 | 689 | TCTGTGGGTTCTTGAATACT | 43 | 6683 | 6702 | 1931 |
| 563518 | 680 | 699 | TAGAGAAATTTCTGTGGGTT | 0 | 6693 | 6712 | 1932 |
| 563519 | 684 | 703 | AAGATAGAGAAATTTCTGTG | 4 | 6697 | 6716 | 1933 |

TABLE 10-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 563520 | 686 | 705 | GGAAGATAGAGAAATTTCTG | 0 | 6699 | 6718 | 1934 |
| 563521 | 694 | 713 | CTTGGCTTGGAAGATAGAGA | 29 | 6707 | 6726 | 1935 |
| 563522 | 696 | 715 | CTCTTGGCTTGGAAGATAGA | 51 | 6709 | 6728 | 1936 |
| 563523 | 705 | 724 | TTCTTGGTGCTCTTGGCTTG | 63 | 6718 | 6737 | 75 |
| 544120 | 707 | 726 | AGTTCTTGGTGCTCTTGGCT | 86 | 6720 | 6739 | 15 |
| 563524 | 715 | 734 | AAGGGAGTAGTTCTTGGTGC | 44 | 6728 | 6747 | 1937 |
| 563525 | 716 | 735 | AAAGGGAGTAGTTCTTGGTG | 14 | 6729 | 6748 | 1938 |
| 563526 | 717 | 736 | GAAAGGGAGTAGTTCTTGGT | 33 | 6730 | 6749 | 1939 |
| 563527 | 718 | 737 | AGAAAGGGAGTAGTTCTTGG | 0 | 6731 | 6750 | 1940 |
| 563528 | 719 | 738 | AAGAAAGGGAGTAGTTCTTG | 0 | 6732 | 6751 | 1941 |
| 563529 | 720 | 739 | GAAGAAAGGGAGTAGTTCTT | 0 | 6733 | 6752 | 1942 |
| 563530 | 726 | 745 | TCAACTGAAGAAAGGGAGTA | 0 | 6739 | 6758 | 1943 |
| 337481 | 728 | 747 | ATTCAACTGAAGAAAGGGAG | 23 | 6741 | 6760 | 1944 |
| 563531 | 729 | 748 | CATTCAACTGAAGAAAGGGA | 16 | 6742 | 6761 | 1945 |
| 563532 | 730 | 749 | TCATTCAACTGAAGAAAGGG | 23 | 6743 | 6762 | 1946 |
| 563533 | 732 | 751 | TTTCATTCAACTGAAGAAAG | 8 | 6745 | 6764 | 1947 |
| 563534 | 733 | 752 | ATTTCATTCAACTGAAGAAA | 6 | 6746 | 6765 | 1948 |
| 563535 | 734 | 753 | TATTTCATTCAACTGAAGAA | 0 | 6747 | 6766 | 1949 |
| 563536 | 735 | 754 | TTATTTCATTCAACTGAAGA | 0 | 6748 | 6767 | 1950 |
| 563537 | 736 | 755 | CTTATTTCATTCAACTGAAG | 11 | 6749 | 6768 | 1951 |
| 337482 | 737 | 756 | TCTTATTTCATTCAACTGAA | 26 | 6750 | 6769 | 1952 |
| 563538 | 738 | 757 | TTCTTATTTCATTCAACTGA | 17 | 6751 | 6770 | 1953 |
| 563539 | 740 | 759 | ATTTCTTATTTCATTCAACT | 18 | 6753 | 6772 | 1954 |
| 563540 | 743 | 762 | TACATTTCTTATTTCATTCA | 20 | 6756 | 6775 | 1955 |
| 563541 | 767 | 786 | TTCAGCAGGAATGCCATCAT | 34 | N/A | N/A | 1956 |
| 563542 | 768 | 787 | ATTCAGCAGGAATGCCATCA | 2 | N/A | N/A | 1957 |
| 563543 | 769 | 788 | CATTCAGCAGGAATGCCATC | 21 | N/A | N/A | 1958 |
| 563544 | 770 | 789 | ACATTCAGCAGGAATGCCAT | 5 | N/A | N/A | 1959 |
| 563545 | 771 | 790 | TACATTCAGCAGGAATGCCA | 37 | N/A | N/A | 1960 |
| 563546 | 772 | 791 | GTACATTCAGCAGGAATGCC | 50 | 7357 | 7376 | 1961 |
| 563547 | 773 | 792 | GGTACATTCAGCAGGAATGC | 64 | 7358 | 7377 | 76 |
| 563548 | 774 | 793 | TGGTACATTCAGCAGGAATG | 42 | 7359 | 7378 | 1962 |
| 563549 | 775 | 794 | GTGGTACATTCAGCAGGAAT | 51 | 7360 | 7379 | 1963 |
| 563550 | 776 | 795 | GGTGGTACATTCAGCAGGAA | 24 | 7361 | 7380 | 1964 |
| 563551 | 777 | 796 | TGGTGGTACATTCAGCAGGA | 47 | 7362 | 7381 | 1965 |

TABLE 10-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 563552 | 778 | 797 | ATGGTGGTACATTCAGCAGG | 0 | 7363 | 7382 | 1966 |
| 563553 | 779 | 798 | AATGGTGGTACATTCAGCAG | 15 | 7364 | 7383 | 1967 |
| 563554 | 780 | 799 | AAATGGTGGTACATTCAGCA | 32 | 7365 | 7384 | 1968 |
| 563555 | 781 | 800 | TAAATGGTGGTACATTCAGC | 29 | 7366 | 7385 | 1969 |
| 563556 | 783 | 802 | TATAAATGGTGGTACATTCA | 33 | 7368 | 7387 | 1970 |
| 563557 | 784 | 803 | TTATAAATGGTGGTACATTC | 1 | 7369 | 7388 | 1971 |
| 563558 | 785 | 804 | GTTATAAATGGTGGTACATT | 4 | 7370 | 7389 | 1972 |
| 563559 | 786 | 805 | TGTTATAAATGGTGGTACAT | 0 | 7371 | 7390 | 1973 |
| 563560 | 787 | 806 | CTGTTATAAATGGTGGTACA | 4 | 7372 | 7391 | 1974 |
| 563561 | 788 | 807 | TCTGTTATAAATGGTGGTAC | 29 | 7373 | 7392 | 1975 |
| 337484 | 789 | 808 | CTCTGTTATAAATGGTGGTA | 62 | 7374 | 7393 | 74 |
| 563562 | 792 | 811 | CACCTCTGTTATAAATGGTG | 22 | 7377 | 7396 | 1976 |
| 563563 | 793 | 812 | TCACCTCTGTTATAAATGGT | 38 | 7378 | 7397 | 1977 |
| 337485 | 794 | 813 | TTCACCTCTGTTATAAATGG | 18 | 7379 | 7398 | 1978 |
| 563564 | 795 | 814 | GTTCACCTCTGTTATAAATG | 52 | 7380 | 7399 | 1979 |
| 563565 | 797 | 816 | ATGTTCACCTCTGTTATAAA | 24 | 7382 | 7401 | 1980 |
| 563566 | 798 | 817 | TATGTTCACCTCTGTTATAA | 2 | 7383 | 7402 | 1981 |
| 337486 | 799 | 818 | GTATGTTCACCTCTGTTATA | 32 | 7384 | 7403 | 1982 |
| 563567 | 800 | 819 | TGTATGTTCACCTCTGTTAT | 38 | 7385 | 7404 | 1983 |
| 337487 | 804 | 823 | CACTTGTATGTTCACCTCTG | 87 | 7389 | 7408 | 28 |
| 563568 | 1128 | 1147 | TAATCGCAACTAGATGTAGC | 39 | 9703 | 9722 | 1984 |
| 563569 | 1129 | 1148 | GTAATCGCAACTAGATGTAG | 26 | 9704 | 9723 | 1985 |
| 563570 | 1130 | 1149 | AGTAATCGCAACTAGATGTA | 17 | 9705 | 9724 | 1986 |
| 563571 | 1131 | 1150 | CAGTAATCGCAACTAGATGT | 43 | 9706 | 9725 | 1987 |
| 563572 | 1132 | 1151 | CCAGTAATCGCAACTAGATG | 39 | 9707 | 9726 | 1988 |
| 563573 | 1133 | 1152 | GCCAGTAATCGCAACTAGAT | 59 | 9708 | 9727 | 1989 |
| 563574 | 1134 | 1153 | TGCCAGTAATCGCAACTAGA | 57 | 9709 | 9728 | 1990 |
| 563575 | 1135 | 1154 | TTGCCAGTAATCGCAACTAG | 54 | 9710 | 9729 | 1991 |
| 563576 | 1136 | 1155 | ATTGCCAGTAATCGCAACTA | 43 | 9711 | 9730 | 1992 |
| 563577 | 1137 | 1156 | CATTGCCAGTAATCGCAACT | 49 | 9712 | 9731 | 1993 |
| 563578 | 1138 | 1157 | ACATTGCCAGTAATCGCAAC | 59 | 9713 | 9732 | 1994 |
| 563579 | 1139 | 1158 | GACATTGCCAGTAATCGCAA | 64 | 9714 | 9733 | 1995 |
| 563580 | 1140 | 1159 | GGACATTGCCAGTAATCGCA | 79 | 9715 | 9734 | 77 |
| 563581 | 1141 | 1160 | GGGACATTGCCAGTAATCGC | 47 | 9716 | 9735 | 1996 |
| 563582 | 1162 | 1181 | TTGTTTTCCGGGATTGCATT | 20 | 9737 | 9756 | 1997 |
| 563583 | 1163 | 1182 | TTTGTTTTCCGGGATTGCAT | 31 | 9738 | 9757 | 1998 |

TABLE 10-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 563584 | 1167 | 1186 | AATCTTTGTTTTCCGGGATT | 14 | 9742 | 9761 | 1999 |
| 563585 | 1168 | 1187 | AAATCTTTGTTTTCCGGGAT | 54 | 9743 | 9762 | 2000 |
| 563586 | 1175 | 1194 | AAACACCAAATCTTTGTTTT | 32 | 9750 | 9769 | 2001 |
| 563587 | 1176 | 1195 | AAAACACCAAATCTTTGTTT | 7 | 9751 | 9770 | 2002 |
| 563588 | 1180 | 1199 | GTAGAAAACACCAAATCTTT | 18 | 9755 | 9774 | 2003 |
| 563589 | 1181 | 1200 | AGTAGAAAACACCAAATCTT | 0 | 9756 | 9775 | 2004 |
| 563590 | 1185 | 1204 | CCCAAGTAGAAAACACCAAA | 26 | 9760 | 9779 | 2005 |
| 563591 | 1186 | 1205 | TCCCAAGTAGAAAACACCAA | 27 | 9761 | 9780 | 2006 |
| 563592 | 1190 | 1209 | GTGATCCCAAGTAGAAAACA | 26 | 9765 | 9784 | 2007 |
| 563593 | 1191 | 1210 | TGTGATCCCAAGTAGAAAAC | 28 | 9766 | 9785 | 2008 |
| 563594 | 1192 | 1211 | TTGTGATCCCAAGTAGAAAA | 12 | 9767 | 9786 | 2009 |
| 563595 | 1193 | 1212 | TTTGTGATCCCAAGTAGAAA | 14 | 9768 | 9787 | 2010 |
| 563596 | 1200 | 1219 | CTTTTGCTTTGTGATCCCAA | 64 | 9775 | 9794 | 2011 |
| 563597 | 1204 | 1223 | TGTCCTTTTGCTTTGTGATC | 24 | 9779 | 9798 | 2012 |
| 563598 | 1205 | 1224 | GTGTCCTTTTGCTTTGTGAT | 31 | 9780 | 9799 | 2013 |
| 563599 | 1206 | 1225 | AGTGTCCTTTTGCTTTGTGA | 41 | 9781 | 9800 | 2014 |
| 563600 | 1210 | 1229 | TTGAAGTGTCCTTTTGCTTT | 21 | 9785 | 9804 | 2015 |
| 563601 | 1211 | 1230 | GTTGAAGTGTCCTTTTGCTT | 35 | 9786 | 9805 | 2016 |
| 563602 | 1212 | 1231 | AGTTGAAGTGTCCTTTTGCT | 27 | 9787 | 9806 | 2017 |
| 563603 | 1213 | 1232 | CAGTTGAAGTGTCCTTTTGC | 17 | 9788 | 9807 | 2018 |
| 563604 | 1214 | 1233 | ACAGTTGAAGTGTCCTTTTG | 0 | 9789 | 9808 | 2019 |
| 563605 | 1215 | 1234 | GACAGTTGAAGTGTCCTTTT | 19 | 9790 | 9809 | 2020 |
| 563606 | 1216 | 1235 | GGACAGTTGAAGTGTCCTTT | 34 | 9791 | 9810 | 2021 |
| 563607 | 1217 | 1236 | TGGACAGTTGAAGTGTCCTT | 12 | 9792 | 9811 | 2022 |
| 563608 | 1218 | 1237 | CTGGACAGTTGAAGTGTCCT | 39 | 9793 | 9812 | 2023 |
| 563609 | 1219 | 1238 | TCTGGACAGTTGAAGTGTCC | 10 | 9794 | 9813 | 2024 |
| 563610 | 1220 | 1239 | CTCTGGACAGTTGAAGTGTC | 6 | 9795 | 9814 | 2025 |
| 563611 | 1221 | 1240 | CCTCTGGACAGTTGAAGTGT | 24 | 9796 | 9815 | 2026 |
| 563612 | 1222 | 1241 | CCCTCTGGACAGTTGAAGTG | 24 | 9797 | 9816 | 2027 |
| 563613 | 1223 | 1242 | ACCCTCTGGACAGTTGAAGT | 31 | 9798 | 9817 | 2028 |
| 563614 | 1224 | 1243 | AACCCTCTGGACAGTTGAAG | 34 | 9799 | 9818 | 2029 |
| 563615 | 1225 | 1244 | TAACCCTCTGGACAGTTGAA | 34 | 9800 | 9819 | 2030 |
| 563616 | 1226 | 1245 | ATAACCCTCTGGACAGTTGA | 31 | 9801 | 9820 | 2031 |
| 563617 | 1227 | 1246 | AATAACCCTCTGGACAGTTG | 22 | 9802 | 9821 | 2032 |
| 563618 | 1228 | 1247 | GAATAACCCTCTGGACAGTT | 25 | 9803 | 9822 | 2033 |

TABLE 10-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 563619 | 1229 | 1248 | TGAATAACCCTCTGGACAGT | 18 | 9804 | 9823 | 2034 |
| 563620 | 1230 | 1249 | CTGAATAACCCTCTGGACAG | 24 | 9805 | 9824 | 2035 |
| 563621 | 1231 | 1250 | CCTGAATAACCCTCTGGACA | 39 | 9806 | 9825 | 2036 |
| 563622 | 1232 | 1251 | TCCTGAATAACCCTCTGGAC | 31 | N/A | N/A | 2037 |
| 563623 | 1233 | 1252 | CTCCTGAATAACCCTCTGGA | 15 | N/A | N/A | 2038 |
| 563624 | 1234 | 1253 | CCTCCTGAATAACCCTCTGG | 27 | N/A | N/A | 2039 |
| 563625 | 1235 | 1254 | GCCTCCTGAATAACCCTCTG | 25 | N/A | N/A | 2040 |
| 563626 | 1236 | 1255 | AGCCTCCTGAATAACCCTCT | 32 | N/A | N/A | 2041 |
| 563627 | 1237 | 1256 | CAGCCTCCTGAATAACCCTC | 44 | N/A | N/A | 2042 |
| 563628 | 1238 | 1257 | CCAGCCTCCTGAATAACCCT | 26 | N/A | N/A | 2043 |
| 563629 | 1239 | 1258 | ACCAGCCTCCTGAATAACCC | 23 | N/A | N/A | 2044 |
| 337503 | 1240 | 1259 | CACCAGCCTCCTGAATAACC | 25 | N/A | N/A | 2045 |
| 563630 | 1241 | 1260 | CCACCAGCCTCCTGAATAAC | 26 | N/A | N/A | 2046 |
| 563631 | 1242 | 1261 | ACCACCAGCCTCCTGAATAA | 25 | N/A | N/A | 2047 |
| 563632 | 1243 | 1262 | CACCACCAGCCTCCTGAATA | 33 | N/A | N/A | 2048 |
| 563633 | 1244 | 1263 | CCACCACCAGCCTCCTGAAT | 45 | N/A | N/A | 2049 |
| 563634 | 1248 | 1267 | CATGCCACCACCAGCCTCCT | 54 | 10220 | 10239 | 2050 |
| 563635 | 1250 | 1269 | ATCATGCCACCACCAGCCTC | 58 | 10222 | 10241 | 2051 |
| 563636 | 1251 | 1270 | CATCATGCCACCACCAGCCT | 61 | 10223 | 10242 | 2052 |
| 563637 | 1255 | 1274 | CACTCATCATGCCACCACCA | 68 | 10227 | 10246 | 78 |
| 563638 | 1256 | 1275 | ACACTCATCATGCCACCACC | 65 | 10228 | 10247 | 2053 |
| 563639 | 1260 | 1279 | CTCCACACTCATCATGCCAC | 76 | 10232 | 10251 | 79 |
| 563640 | 1262 | 1281 | TTCTCCACACTCATCATGCC | 55 | 10234 | 10253 | 2054 |
| 563641 | 1263 | 1282 | TTTCTCCACACTCATCATGC | 63 | 10235 | 10254 | 80 |
| 563642 | 1264 | 1283 | TTTTCTCCACACTCATCATG | 24 | 10236 | 10255 | 2055 |
| 563643 | 1265 | 1284 | GTTTTCTCCACACTCATCAT | 53 | 10237 | 10256 | 2056 |
| 563644 | 1857 | 1876 | ATTTAAGAACTGTACAATTA | 7 | 10829 | 10848 | 2057 |
| 563645 | 1858 | 1877 | CATTTAAGAACTGTACAATT | 15 | 10830 | 10849 | 2058 |
| 563646 | 1859 | 1878 | ACATTTAAGAACTGTACAAT | 4 | 10831 | 10850 | 2059 |
| 563647 | 1860 | 1879 | AACATTTAAGAACTGTACAA | 4 | 10832 | 10851 | 2060 |
| 563648 | 1861 | 1880 | CAACATTTAAGAACTGTACA | 4 | 10833 | 10852 | 2061 |
| 563649 | 1862 | 1881 | ACAACATTTAAGAACTGTAC | 22 | 10834 | 10853 | 2062 |
| 563650 | 1863 | 1882 | TACAACATTTAAGAACTGTA | 21 | 10835 | 10854 | 2063 |
| 563651 | 1864 | 1883 | CTACAACATTTAAGAACTGT | 44 | 10836 | 10855 | 2064 |
| 563652 | 1865 | 1884 | ACTACAACATTTAAGAACTG | 20 | 10837 | 10856 | 2065 |
| 563653 | 1866 | 1885 | TACTACAACATTTAAGAACT | 15 | 10838 | 10857 | 2066 |

TABLE 10-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 563654 | 1867 | 1886 | ATACTACAACATTTAAGAAC | 17 | 10839 | 10858 | 2067 |
| 563655 | 1868 | 1887 | AATACTACAACATTTAAGAA | 11 | 10840 | 10859 | 2068 |
| 563656 | 1869 | 1888 | TAATACTACAACATTTAAGA | 9 | 10841 | 10860 | 2069 |
| 563657 | 1870 | 1889 | TTAATACTACAACATTTAAG | 3 | 10842 | 10861 | 2070 |
| 563658 | 1874 | 1893 | GAAATTAATACTACAACATT | 0 | 10846 | 10865 | 2071 |
| 563659 | 1878 | 1897 | TTTTGAAATTAATACTACAA | 0 | 10850 | 10869 | 2072 |
| 563660 | 1879 | 1898 | GTTTTGAAATTAATACTACA | 15 | 10851 | 10870 | 2073 |
| 563661 | 1880 | 1899 | AGTTTTGAAATTAATACTAC | 2 | 10852 | 10871 | 2074 |
| 563662 | 1881 | 1900 | TAGTTTTGAAATTAATACTA | 14 | 10853 | 10872 | 2075 |
| 563663 | 1882 | 1901 | TTAGTTTTGAAATTAATACT | 8 | 10854 | 10873 | 2076 |
| 563664 | 1888 | 1907 | CGATTTTTAGTTTTGAAATT | 0 | 10860 | 10879 | 2077 |
| 563665 | 1889 | 1908 | ACGATTTTTAGTTTTGAAAT | 0 | 10861 | 10880 | 2078 |
| 563666 | 1890 | 1909 | GACGATTTTTAGTTTTGAAA | 20 | 10862 | 10881 | 2079 |
| 563667 | 1891 | 1910 | TGACGATTTTTAGTTTTGAA | 17 | 10863 | 10882 | 2080 |
| 563668 | 1892 | 1911 | CTGACGATTTTTAGTTTTGA | 64 | 10864 | 10883 | 2081 |
| 563669 | 1893 | 1912 | GCTGACGATTTTTAGTTTTG | 66 | 10865 | 10884 | 81 |
| 563670 | 1894 | 1913 | TGCTGACGATTTTTAGTTTT | 45 | 10866 | 10885 | 2082 |
| 563671 | 1895 | 1914 | GTGCTGACGATTTTTAGTTT | 42 | 10867 | 10886 | 2083 |
| 563672 | 1896 | 1915 | TGTGCTGACGATTTTTAGTT | 50 | 10868 | 10887 | 2084 |
| 563673 | 1897 | 1916 | CTGTGCTGACGATTTTTAGT | 55 | 10869 | 10888 | 2085 |
| 563674 | 1898 | 1917 | TCTGTGCTGACGATTTTTAG | 53 | 10870 | 10889 | 2086 |
| 563675 | 1899 | 1918 | CTCTGTGCTGACGATTTTTA | 49 | 10871 | 10890 | 2087 |
| 563676 | 1900 | 1919 | ACTCTGTGCTGACGATTTTT | 22 | 10872 | 10891 | 2088 |
| 563677 | 1901 | 1920 | TACTCTGTGCTGACGATTTT | 8 | 10873 | 10892 | 2089 |
| 563678 | 1902 | 1921 | ATACTCTGTGCTGACGATTT | 61 | 10874 | 10893 | 2090 |
| 563679 | 1903 | 1922 | CATACTCTGTGCTGACGATT | 68 | 10875 | 10894 | 2091 |
| 563680 | 1904 | 1923 | ACATACTCTGTGCTGACGAT | 4 | 10876 | 10895 | 2092 |
| 563681 | 1905 | 1924 | CACATACTCTGTGCTGACGA | 73 | 10877 | 10896 | 82 |
| 563682 | 1909 | 1928 | TTTACACATACTCTGTGCTG | 67 | 10881 | 10900 | 83 |
| 563683 | 1911 | 1930 | TTTTTACACATACTCTGTGC | 58 | 10883 | 10902 | 2093 |
| 563684 | 1915 | 1934 | CAGATTTTTACACATACTCT | 54 | 10887 | 10906 | 2094 |
| 563685 | 1916 | 1935 | ACAGATTTTTACACATACTC | 52 | 10888 | 10907 | 2095 |
| 563686 | 1917 | 1936 | TACAGATTTTTACACATACT | 40 | 10889 | 10908 | 2096 |
| 563687 | 1918 | 1937 | TTACAGATTTTTACACATAC | 22 | 10890 | 10909 | 2097 |
| 337528 | 1920 | 1939 | TATTACAGATTTTTACACAT | 4 | 6720 | 6739 | 2098 |

TABLE 10-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 563688 | 1922 | 1941 | TGTATTACAGATTTTTACAC | 0 | 10894 | 10913 | 2099 |
| 563689 | 1935 | 1954 | CAGTTTAAAAATTTGTATTA | 8 | 10907 | 10926 | 2100 |
| 563690 | 1938 | 1957 | CATCAGTTTAAAAATTTGTA | 18 | 10910 | 10929 | 2101 |
| 563691 | 1941 | 1960 | AAGCATCAGTTTAAAAATTT | 16 | 10913 | 10932 | 2102 |
| 563692 | 1942 | 1961 | GAAGCATCAGTTTAAAAATT | 16 | 10914 | 10933 | 2103 |
| 563693 | 1951 | 1970 | TAGCAAAATGAAGCATCAGT | 40 | 10923 | 10942 | 2104 |
| 563694 | 1952 | 1971 | GTAGCAAAATGAAGCATCAG | 42 | 10924 | 10943 | 2105 |
| 563695 | 1953 | 1972 | TGTAGCAAAATGAAGCATCA | 44 | 10925 | 10944 | 2106 |
| 563696 | 1954 | 1973 | TTGTAGCAAAATGAAGCATC | 48 | 10926 | 10945 | 2107 |
| 563697 | 1955 | 1974 | TTTGTAGCAAAATGAAGCAT | 19 | 10927 | 10946 | 2108 |
| 563698 | 1974 | 1993 | AACATTTACTCCAAATTATT | 27 | 10946 | 10965 | 2109 |
| 563699 | 1976 | 1995 | CAAACATTTACTCCAAATTA | 23 | 10948 | 10967 | 2110 |
| 563700 | 1978 | 1997 | ATCAAACATTTACTCCAAAT | 24 | 10950 | 10969 | 2111 |
| 563701 | 1981 | 2000 | CATATCAAACATTTACTCCA | 61 | 10953 | 10972 | 2112 |
| 563702 | 1982 | 2001 | TCATATCAAACATTTACTCC | 50 | 10954 | 10973 | 2113 |
| 563703 | 1983 | 2002 | ATCATATCAAACATTTACTC | 31 | 10955 | 10974 | 2114 |
| 563704 | 1990 | 2009 | TAAATAAATCATATCAAACA | 10 | 10962 | 10981 | 2115 |
| 563705 | 1993 | 2012 | TCATAAATAAATCATATCAA | 20 | 10965 | 10984 | 2116 |
| 563706 | 1994 | 2013 | TTCATAAATAAATCATATCA | 11 | 10966 | 10985 | 2117 |
| 563707 | 1995 | 2014 | TTTCATAAATAAATCATATC | 5 | 10967 | 10986 | 2118 |
| 563708 | 1996 | 2015 | GTTTCATAAATAAATCATAT | 0 | 10968 | 10987 | 2119 |
| 563709 | 1997 | 2016 | GGTTTCATAAATAAATCATA | 8 | 10969 | 10988 | 2120 |
| 563710 | 1998 | 2017 | AGGTTTCATAAATAAATCAT | 15 | 10970 | 10989 | 2121 |
| 563711 | 1999 | 2018 | TAGGTTTCATAAATAAATCA | 19 | 10971 | 10990 | 2122 |
| 563712 | 2001 | 2020 | ATTAGGTTTCATAAATAAAT | 12 | 10973 | 10992 | 2123 |
| 563713 | 2002 | 2021 | CATTAGGTTTCATAAATAAA | 2 | 10974 | 10993 | 2124 |
| 563714 | 2003 | 2022 | TCATTAGGTTTCATAAATAA | 7 | 10975 | 10994 | 2125 |
| 563715 | 2004 | 2023 | TTCATTAGGTTTCATAAATA | 11 | 10976 | 10995 | 2126 |
| 563716 | 2005 | 2024 | CTTCATTAGGTTTCATAAAT | 15 | 10977 | 10996 | 2127 |
| 563717 | 2006 | 2025 | GCTTCATTAGGTTTCATAAA | 49 | 10978 | 10997 | 2128 |
| 563718 | 2010 | 2029 | TTCTGCTTCATTAGGTTTCA | 57 | 10982 | 11001 | 2129 |
| 563719 | 2013 | 2032 | TAATTCTGCTTCATTAGGTT | 43 | 10985 | 11004 | 2130 |

TABLE 11

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 566915 | 343 | 362 | TATGTAGTTCTTCTCAGTTC | 22 | 3447 | 3466 | 2131 |
| 566916 | 350 | 369 | TAGTTTATATGTAGTTCTTC | 21 | 3454 | 3473 | 2132 |
| 566917 | 354 | 373 | CTTGTAGTTTATATGTAGTT | 12 | 3458 | 3477 | 2133 |
| 566918 | 358 | 377 | TTGACTTGTAGTTTATATGT | 12 | 3462 | 3481 | 2134 |
| 566919 | 360 | 379 | TTTTGACTTGTAGTTTATAT | 0 | 3464 | 3483 | 2135 |
| 566920 | 362 | 381 | ATTTTGACTTGTAGTTTAT | 7 | 3466 | 3485 | 2136 |
| 566921 | 367 | 386 | TCTTCATTTTGACTTGTAG | 33 | 3471 | 3490 | 2137 |
| 566922 | 371 | 390 | TACCTCTTCATTTTGACTT | 22 | 3475 | 3494 | 2138 |
| 566923 | 377 | 396 | ATTCTTTACCTCTTCATTTT | 12 | 3481 | 3500 | 2139 |
| 566924 | 387 | 406 | CAAGTGACATATTCTTTACC | 36 | 3491 | 3510 | 2140 |
| 566925 | 389 | 408 | TTCAAGTGACATATTCTTTA | 31 | 3493 | 3512 | 2141 |
| 566926 | 394 | 413 | TTGAGTTCAAGTGACATATT | 18 | 3498 | 3517 | 2142 |
| 566927 | 396 | 415 | AGTTGAGTTCAAGTGACATA | 6 | 3500 | 3519 | 2143 |
| 566928 | 400 | 419 | TTTGAGTTGAGTTCAAGTGA | 11 | 3504 | 3523 | 2144 |
| 566929 | 408 | 427 | TTTCAAGTTTTGAGTTGAGT | 15 | 3512 | 3531 | 2145 |
| 566930 | 410 | 429 | GCTTTCAAGTTTTGAGTTGA | 13 | 3514 | 3533 | 2146 |
| 566931 | 412 | 431 | AGGCTTTCAAGTTTTGAGTT | 22 | 3516 | 3535 | 2147 |
| 566932 | 416 | 435 | TAGGAGGCTTTCAAGTTTTG | 4 | 3520 | 3539 | 2148 |
| 566933 | 419 | 438 | TTCTAGGAGGCTTTCAAGTT | 35 | 3523 | 3542 | 2149 |
| 566934 | 421 | 440 | TCTTCTAGGAGGCTTTCAAG | 26 | 3525 | 3544 | 2150 |
| 566935 | 429 | 448 | GAATTTTTCTTCTAGGAGG | 1 | 3533 | 3552 | 2151 |
| 566936 | 434 | 453 | AAGTAGAATTTTTCTTCTA | 0 | 3538 | 3557 | 2152 |
| 566937 | 436 | 455 | TGAAGTAGAATTTTTCTTC | 11 | 3540 | 3559 | 2153 |
| 566938 | 438 | 457 | GTTGAAGTAGAATTTTTCT | 29 | 3542 | 3561 | 2154 |
| 566939 | 441 | 460 | TTTGTTGAAGTAGAATTTTT | 11 | 3545 | 3564 | 2155 |
| 566940 | 443 | 462 | TTTTTGTTGAAGTAGAATTT | 35 | 3547 | 3566 | 2156 |
| 566941 | 464 | 483 | TTGCTCTTCTAAATATTTCA | 35 | 3568 | 3587 | 2157 |
| 566942 | 466 | 485 | AGTTGCTCTTCTAAATATTT | 53 | 3570 | 3589 | 2158 |
| 566943 | 468 | 487 | TTAGTTGCTCTTCTAAATAT | 18 | 3572 | 3591 | 2159 |
| 566944 | 471 | 490 | TAGTTAGTTGCTCTTCTAAA | 38 | 3575 | 3594 | 2160 |
| 566945 | 476 | 495 | TAAGTTAGTTAGTTGCTCTT | 28 | 3580 | 3599 | 2161 |
| 566946 | 478 | 497 | ATTAAGTTAGTTAGTTGCTC | 28 | 3582 | 3601 | 2162 |
| 566947 | 480 | 499 | GAATTAAGTTAGTTAGTTGC | 27 | 3584 | 3603 | 2163 |
| 566948 | 482 | 501 | TTGAATTAAGTTAGTTAGTT | 21 | 3586 | 3605 | 2164 |
| 566949 | 484 | 503 | TTTTGAATTAAGTTAGTTAG | 2 | 3588 | 3607 | 2165 |
| 566950 | 487 | 506 | TGATTTTGAATTAAGTTAGT | 9 | 3591 | 3610 | 2166 |

TABLE 11-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 566951 | 490 | 509 | GGTTGATTTTGAATTAAGTT | 52 | 3594 | 3613 | 2167 |
| 566952 | 497 | 516 | AGTTTCAGGTTGATTTTGAA | 13 | 3601 | 3620 | 2168 |
| 566953 | 501 | 520 | CTGGAGTTTCAGGTTGATTT | 50 | 3605 | 3624 | 2169 |
| 566954 | 507 | 526 | GGTGTTCTGGAGTTTCAGGT | 35 | 3611 | 3630 | 2170 |
| 566955 | 509 | 528 | TGGGTGTTCTGGAGTTTCAG | 18 | 3613 | 3632 | 2171 |
| 566956 | 511 | 530 | TCTGGGTGTTCTGGAGTTTC | 32 | 3615 | 3634 | 2172 |
| 566957 | 513 | 532 | CTTCTGGGTGTTCTGGAGTT | 28 | 3617 | 3636 | 2173 |
| 566958 | 515 | 534 | TACTTCTGGGTGTTCTGGAG | 23 | 3619 | 3638 | 2174 |
| 566959 | 517 | 536 | GTTACTTCTGGGTGTTCTGG | 12 | 3621 | 3640 | 2175 |
| 566960 | 519 | 538 | AAGTTACTTCTGGGTGTTCT | 1 | 3623 | 3642 | 2176 |
| 566961 | 522 | 541 | GTGAAGTTACTTCTGGGTGT | 0 | 3626 | 3645 | 2177 |
| 566962 | 528 | 547 | TTTTAAGTGAAGTTACTTCT | 6 | N/A | N/A | 2178 |
| 566963 | 530 | 549 | AGTTTTAAGTGAAGTTACTT | 16 | N/A | N/A | 2179 |
| 566964 | 532 | 551 | AAAGTTTTAAGTGAAGTTAC | 12 | N/A | N/A | 2180 |
| 566965 | 535 | 554 | ACAAAAGTTTTAAGTGAAGT | 8 | N/A | N/A | 2181 |
| 337474 | 537 | 556 | CTACAAAAGTTTTAAGTGAA | 10 | N/A | N/A | 2182 |
| 566966 | 539 | 558 | TTCTACAAAAGTTTTAAGTG | 46 | N/A | N/A | 2183 |
| 566967 | 544 | 563 | TGTTTTTCTACAAAAGTTTT | 12 | N/A | N/A | 2184 |
| 566968 | 546 | 565 | CTTGTTTTTCTACAAAAGTT | 0 | N/A | N/A | 2185 |
| 566969 | 552 | 571 | TATTATCTTGTTTTTCTACA | 0 | 4290 | 4309 | 2186 |
| 566970 | 557 | 576 | GATGCTATTATCTTGTTTTT | 18 | 4295 | 4314 | 2187 |
| 566971 | 560 | 579 | TTTGATGCTATTATCTTGTT | 22 | 4298 | 4317 | 2188 |
| 566972 | 562 | 581 | TCTTTGATGCTATTATCTTG | 21 | 4300 | 4319 | 2189 |
| 566973 | 569 | 588 | GAGAAGGTCTTTGATGCTAT | 37 | 4307 | 4326 | 2190 |
| 566974 | 574 | 593 | GTCTGGAGAAGGTCTTTGAT | 26 | 4312 | 4331 | 2191 |
| 566975 | 576 | 595 | CGGTCTGGAGAAGGTCTTTG | 20 | 4314 | 4333 | 2192 |
| 566976 | 578 | 597 | CACGGTCTGGAGAAGGTCTT | 53 | 4316 | 4335 | 2193 |
| 566977 | 580 | 599 | TCCACGGTCTGGAGAAGGTC | 58 | 4318 | 4337 | 2194 |
| 566978 | 582 | 601 | CTTCCACGGTCTGGAGAAGG | 39 | 4320 | 4339 | 2195 |
| 566979 | 584 | 603 | GTCTTCCACGGTCTGGAGAA | 63 | 4322 | 4341 | 2196 |
| 566980 | 586 | 605 | TGGTCTTCCACGGTCTGGAG | 81 | 4324 | 4343 | 2197 |
| 566981 | 588 | 607 | ATTGGTCTTCCACGGTCTGG | 57 | 4326 | 4345 | 2198 |
| 566982 | 590 | 609 | ATATTGGTCTTCCACGGTCT | 60 | 4328 | 4347 | 2199 |
| 566983 | 592 | 611 | TTATATTGGTCTTCCACGGT | 49 | 4330 | 4349 | 2200 |
| 566984 | 594 | 613 | GTTTATATTGGTCTTCCACG | 54 | 4332 | 4351 | 2201 |

TABLE 11-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 566985 | 596 | 615 | TTGTTTATATTGGTCTTCCA | 36 | 4334 | 4353 | 2202 |
| 566986 | 598 | 617 | AATTGTTTATATTGGTCTTC | 23 | 4336 | 4355 | 2203 |
| 566987 | 600 | 619 | TTAATTGTTTATATTGGTCT | 26 | 4338 | 4357 | 2204 |
| 566988 | 602 | 621 | GTTTAATTGTTTATATTGGT | 23 | 4340 | 4359 | 2205 |
| 566989 | 604 | 623 | TGGTTTAATTGTTTATATTG | 8 | 4342 | 4361 | 2206 |
| 566990 | 606 | 625 | GTTGGTTTAATTGTTTATAT | 1 | 4344 | 4363 | 2207 |
| 544120 | 707 | 726 | AGTTCTTGGTGCTCTTGGCT | 78 | 6720 | 6739 | 15 |
| 337487 | 804 | 823 | CACTTGTATGTTCACCTCTG | 82 | 7389 | 7408 | 28 |
| 566991 | 912 | 931 | TTTGTGATCCATCTATTCGA | 25 | 7899 | 7918 | 2208 |
| 566992 | 913 | 932 | TTTTGTGATCCATCTATTCG | 12 | 7900 | 7919 | 2209 |
| 566993 | 920 | 939 | ATTGAAGTTTTGTGATCCAT | 32 | 7907 | 7926 | 2210 |
| 566994 | 921 | 940 | CATTGAAGTTTTGTGATCCA | 26 | 7908 | 7927 | 2211 |
| 566995 | 922 | 941 | TCATTGAAGTTTTGTGATCC | 0 | 7909 | 7928 | 2212 |
| 566996 | 923 | 942 | TTCATTGAAGTTTTGTGATC | 1 | 7910 | 7929 | 2213 |
| 566997 | 924 | 943 | TTTCATTGAAGTTTTGTGAT | 20 | 7911 | 7930 | 2214 |
| 566998 | 944 | 963 | ATATTTGTAGTTCTCCCACG | 35 | 7931 | 7950 | 2215 |
| 566999 | 952 | 971 | CCAAAACCATATTTGTAGTT | 13 | 7939 | 7958 | 2216 |
| 567000 | 953 | 972 | CCCAAAACCATATTTGTAGT | 21 | 7940 | 7959 | 2217 |
| 567001 | 954 | 973 | TCCCAAAACCATATTTGTAG | 0 | 7941 | 7960 | 2218 |
| 567002 | 955 | 974 | CTCCCAAAACCATATTTGTA | 5 | 7942 | 7961 | 2219 |
| 567003 | 958 | 977 | AGCCTCCCAAAACCATATTT | 0 | 7945 | 7964 | 2220 |
| 567004 | 960 | 979 | CAAGCCTCCCAAAACCATAT | 14 | 7947 | 7966 | 2221 |
| 567005 | 961 | 980 | TCAAGCCTCCCAAAACCATA | 0 | 7948 | 7967 | 2222 |
| 567006 | 962 | 981 | ATCAAGCCTCCCAAAACCAT | 17 | 7949 | 7968 | 2223 |
| 567007 | 963 | 982 | CATCAAGCCTCCCAAAACCA | 31 | 7950 | 7969 | 2224 |
| 567008 | 964 | 983 | CCATCAAGCCTCCCAAAACC | 11 | 7951 | 7970 | 2225 |
| 567009 | 965 | 984 | TCCATCAAGCCTCCCAAAAC | 27 | N/A | N/A | 2226 |
| 567010 | 966 | 985 | CTCCATCAAGCCTCCCAAAA | 42 | N/A | N/A | 2227 |
| 567011 | 972 | 991 | AAAATTCTCCATCAAGCCTC | 48 | N/A | N/A | 2228 |
| 567012 | 974 | 993 | CCAAAATTCTCCATCAAGCC | 41 | N/A | N/A | 2229 |
| 567013 | 975 | 994 | ACCAAAATTCTCCATCAAGC | 49 | N/A | N/A | 2230 |
| 567014 | 978 | 997 | CCAACCAAAATTCTCCATCA | 32 | N/A | N/A | 2231 |
| 567015 | 979 | 998 | CCCAACCAAAATTCTCCATC | 47 | N/A | N/A | 2232 |
| 337497 | 980 | 999 | GCCCAACCAAAATTCTCCAT | 46 | N/A | N/A | 2233 |
| 567016 | 981 | 1000 | GGCCCAACCAAAATTCTCCA | 48 | N/A | N/A | 2234 |
| 567017 | 982 | 1001 | AGGCCCAACCAAAATTCTCC | 30 | 9557 | 9576 | 2235 |

TABLE 11-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 567018 | 983 | 1002 | TAGGCCCAACCAAAATTCTC | 0 | 9558 | 9577 | 2236 |
| 567019 | 984 | 1003 | CTAGGCCCAACCAAAATTCT | 31 | 9559 | 9578 | 2237 |
| 567020 | 985 | 1004 | TCTAGGCCCAACCAAAATTC | 39 | 9560 | 9579 | 2238 |
| 233721 | 986 | 1005 | CTCTAGGCCCAACCAAAATT | 15 | 9561 | 9580 | 2239 |
| 567021 | 987 | 1006 | TCTCTAGGCCCAACCAAAAT | 36 | 9562 | 9581 | 2240 |
| 567022 | 988 | 1007 | TTCTCTAGGCCCAACCAAAA | 26 | 9563 | 9582 | 2241 |
| 567023 | 989 | 1008 | CTTCTCTAGGCCCAACCAAA | 44 | 9564 | 9583 | 2242 |
| 567024 | 993 | 1012 | ATATCTTCTCTAGGCCCAAC | 29 | 9568 | 9587 | 2243 |
| 567025 | 994 | 1013 | TATATCTTCTCTAGGCCCAA | 41 | 9569 | 9588 | 2244 |
| 567026 | 995 | 1014 | GTATATCTTCTCTAGGCCCA | 53 | 9570 | 9589 | 2245 |
| 567027 | 1000 | 1019 | ATGGAGTATATCTTCTCTAG | 18 | 9575 | 9594 | 2246 |
| 567028 | 1004 | 1023 | CACTATGGAGTATATCTTCT | 35 | 9579 | 9598 | 2247 |
| 567029 | 1005 | 1024 | TCACTATGGAGTATATCTTC | 9 | 9580 | 9599 | 2248 |
| 567030 | 1006 | 1025 | TTCACTATGGAGTATATCTT | 11 | 9581 | 9600 | 2249 |
| 567031 | 1010 | 1029 | TTGCTTCACTATGGAGTATA | 43 | 9585 | 9604 | 2250 |
| 567032 | 1011 | 1030 | ATTGCTTCACTATGGAGTAT | 4 | 9586 | 9605 | 2251 |
| 567033 | 1015 | 1034 | TTAGATTGCTTCACTATGGA | 17 | 9590 | 9609 | 2252 |
| 567034 | 1016 | 1035 | ATTAGATTGCTTCACTATGG | 35 | 9591 | 9610 | 2253 |
| 567035 | 1017 | 1036 | AATTAGATTGCTTCACTATG | 18 | 9592 | 9611 | 2254 |
| 567036 | 1018 | 1037 | TAATTAGATTGCTTCACTAT | 17 | 9593 | 9612 | 2255 |
| 567037 | 1019 | 1038 | ATAATTAGATTGCTTCACTA | 19 | 9594 | 9613 | 2256 |
| 567038 | 1020 | 1039 | CATAATTAGATTGCTTCACT | 27 | 9595 | 9614 | 2257 |
| 567039 | 1021 | 1040 | ACATAATTAGATTGCTTCAC | 17 | 9596 | 9615 | 2258 |
| 337498 | 1022 | 1041 | AACATAATTAGATTGCTTCA | 9 | 9597 | 9616 | 2259 |
| 567040 | 1023 | 1042 | AAACATAATTAGATTGCTTC | 0 | 9598 | 9617 | 2260 |
| 567041 | 1024 | 1043 | AAAACATAATTAGATTGCTT | 0 | 9599 | 9618 | 2261 |
| 567042 | 1025 | 1044 | TAAAACATAATTAGATTGCT | 23 | 9600 | 9619 | 2262 |
| 567043 | 1026 | 1045 | GTAAAACATAATTAGATTGC | 25 | 9601 | 9620 | 2263 |
| 567044 | 1027 | 1046 | CGTAAAACATAATTAGATTG | 0 | 9602 | 9621 | 2264 |
| 567045 | 1048 | 1067 | TTCCAGTCTTCCAACTCAAT | 9 | 9623 | 9642 | 2265 |
| 337500 | 1050 | 1069 | CTTTCCAGTCTTCCAACTCA | 30 | 9625 | 9644 | 2266 |
| 567046 | 1057 | 1076 | TTGTTGTCTTTCCAGTCTTC | 40 | 9632 | 9651 | 2267 |
| 567047 | 1064 | 1083 | ATAATGTTTGTTGTCTTTCC | 26 | 9639 | 9658 | 2268 |
| 567048 | 1065 | 1084 | TATAATGTTTGTTGTCTTTC | 6 | 9640 | 9659 | 2269 |
| 567049 | 1066 | 1085 | ATATAATGTTTGTTGTCTTT | 9 | 9641 | 9660 | 2270 |

TABLE 11-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 567050 | 1069 | 1088 | TCAATATAATGTTTGTTGTC | 20 | 9644 | 9663 | 2271 |
| 567051 | 1073 | 1092 | ATATTCAATATAATGTTTGT | 15 | 9648 | 9667 | 2272 |
| 567052 | 1074 | 1093 | AATATTCAATATAATGTTTG | 16 | 9649 | 9668 | 2273 |
| 567053 | 1075 | 1094 | GAATATTCAATATAATGTTT | 7 | 9650 | 9669 | 2274 |
| 567054 | 1076 | 1095 | AGAATATTCAATATAATGTT | 3 | 9651 | 9670 | 2275 |
| 567055 | 1077 | 1096 | AAGAATATTCAATATAATGT | 7 | 9652 | 9671 | 2276 |
| 567056 | 1085 | 1104 | CAAGTAAAAGAATATTCAA | 0 | 9660 | 9679 | 2277 |
| 567057 | 1086 | 1105 | CCAAGTAAAAGAATATTCA | 0 | 9661 | 9680 | 2278 |
| 567058 | 1087 | 1106 | CCCAAGTAAAAGAATATTC | 13 | 9662 | 9681 | 2279 |
| 567059 | 1090 | 1109 | TTTCCCAAGTAAAAGAATA | 0 | 9665 | 9684 | 2280 |
| 567060 | 1091 | 1110 | ATTTCCCAAGTAAAAGAAT | 2 | 9666 | 9685 | 2281 |
| 567061 | 1092 | 1111 | GATTTCCCAAGTAAAAGAA | 14 | 9667 | 9686 | 2282 |
| 567062 | 1093 | 1112 | TGATTTCCCAAGTAAAAGA | 14 | 9668 | 9687 | 2283 |
| 567063 | 1127 | 1146 | AATCGCAACTAGATGTAGCG | 15 | 9702 | 9721 | 2284 |
| 563874 | 1586 | 1605 | ATTCTTTAAGGTTATGTGAT | 13 | 10558 | 10577 | 2285 |
| 563875 | 1587 | 1606 | TATTCTTTAAGGTTATGTGA | 25 | 10559 | 10578 | 2286 |
| 563876 | 1591 | 1610 | ACGGTATTCTTTAAGGTTAT | 50 | 10563 | 10582 | 2287 |
| 563877 | 1592 | 1611 | AACGGTATTCTTTAAGGTTA | 48 | 10564 | 10583 | 2288 |
| 563878 | 1593 | 1612 | AAACGGTATTCTTTAAGGTT | 45 | 10565 | 10584 | 2289 |
| 563879 | 1594 | 1613 | TAAACGGTATTCTTTAAGGT | 16 | 10566 | 10585 | 2290 |
| 563880 | 1595 | 1614 | GTAAACGGTATTCTTTAAGG | 14 | 10567 | 10586 | 2291 |
| 563881 | 1596 | 1615 | TGTAAACGGTATTCTTTAAG | 0 | 10568 | 10587 | 2292 |
| 563882 | 1597 | 1616 | ATGTAAACGGTATTCTTTAA | 10 | 10569 | 10588 | 2293 |
| 563883 | 1598 | 1617 | AATGTAAACGGTATTCTTTA | 12 | 10570 | 10589 | 2294 |
| 563884 | 1599 | 1618 | AAATGTAAACGGTATTCTTT | 15 | 10571 | 10590 | 2295 |
| 563885 | 1600 | 1619 | GAAATGTAAACGGTATTCTT | 13 | 10572 | 10591 | 2296 |
| 563886 | 1601 | 1620 | AGAAATGTAAACGGTATTCT | 22 | 10573 | 10592 | 2297 |
| 563887 | 1602 | 1621 | GAGAAATGTAAACGGTATTC | 35 | 10574 | 10593 | 2298 |
| 563888 | 1603 | 1622 | TGAGAAATGTAAACGGTATT | 14 | 10575 | 10594 | 2299 |
| 563889 | 1604 | 1623 | TTGAGAAATGTAAACGGTAT | 0 | 10576 | 10595 | 2300 |
| 563890 | 1605 | 1624 | ATTGAGAAATGTAAACGGTA | 18 | 10577 | 10596 | 2301 |
| 563891 | 1606 | 1625 | GATTGAGAAATGTAAACGGT | 40 | 10578 | 10597 | 2302 |
| 563892 | 1607 | 1626 | TGATTGAGAAATGTAAACGG | 33 | 10579 | 10598 | 2303 |
| 563893 | 1608 | 1627 | TTGATTGAGAAATGTAAACG | 7 | 10580 | 10599 | 2304 |
| 563894 | 1609 | 1628 | TTTGATTGAGAAATGTAAAC | 0 | 10581 | 10600 | 2305 |
| 563895 | 1610 | 1629 | TTTTGATTGAGAAATGTAAA | 0 | 10582 | 10601 | 2306 |

TABLE 11-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 563896 | 1611 | 1630 | ATTTTGATTGAGAAATGTAA | 0 | 10583 | 10602 | 2307 |
| 563897 | 1612 | 1631 | AATTTTGATTGAGAAATGTA | 0 | 10584 | 10603 | 2308 |
| 563898 | 1613 | 1632 | GAATTTTGATTGAGAAATGT | 4 | 10585 | 10604 | 2309 |
| 563899 | 1614 | 1633 | AGAATTTTGATTGAGAAATG | 4 | 10586 | 10605 | 2310 |
| 563900 | 1615 | 1634 | AAGAATTTTGATTGAGAAAT | 26 | 10587 | 10606 | 2311 |
| 563901 | 1617 | 1636 | ATAAGAATTTTGATTGAGAA | 4 | 10589 | 10608 | 2312 |
| 563902 | 1618 | 1637 | TATAAGAATTTTGATTGAGA | 0 | 10590 | 10609 | 2313 |
| 563903 | 1619 | 1638 | TTATAAGAATTTTGATTGAG | 0 | 10591 | 10610 | 2314 |
| 563904 | 1620 | 1639 | ATTATAAGAATTTTGATTGA | 0 | 10592 | 10611 | 2315 |
| 563905 | 1621 | 1640 | TATTATAAGAATTTTGATTG | 3 | 10593 | 10612 | 2316 |
| 563906 | 1622 | 1641 | GTATTATAAGAATTTTGATT | 1 | 10594 | 10613 | 2317 |
| 563907 | 1623 | 1642 | AGTATTATAAGAATTTTGAT | 44 | 10595 | 10614 | 2318 |
| 563908 | 1624 | 1643 | TAGTATTATAAGAATTTTGA | 29 | 10596 | 10615 | 2319 |
| 563909 | 1632 | 1651 | AAAACAAATAGTATTATAAG | 11 | 10604 | 10623 | 2320 |
| 563910 | 1633 | 1652 | TAAAACAAATAGTATTATAA | 16 | 10605 | 10624 | 2321 |
| 563911 | 1652 | 1671 | ATTCCCACATCACAAAATTT | 27 | 10624 | 10643 | 2322 |
| 563912 | 1653 | 1672 | GATTCCCACATCACAAAATT | 21 | 10625 | 10644 | 2323 |
| 563913 | 1654 | 1673 | TGATTCCCACATCACAAAAT | 49 | 10626 | 10645 | 2324 |
| 563914 | 1658 | 1677 | AAATTGATTCCCACATCACA | 47 | 10630 | 10649 | 2325 |
| 563915 | 1659 | 1678 | AAAATTGATTCCCACATCAC | 48 | 10631 | 10650 | 2326 |
| 563916 | 1663 | 1682 | ATCTAAAATTGATTCCCACA | 58 | 10635 | 10654 | 2327 |
| 563917 | 1667 | 1686 | GACCATCTAAAATTGATTCC | 41 | 10639 | 10658 | 2328 |
| 563918 | 1668 | 1687 | TGACCATCTAAAATTGATTC | 25 | 10640 | 10659 | 2329 |
| 563919 | 1669 | 1688 | GTGACCATCTAAAATTGATT | 33 | 10641 | 10660 | 2330 |
| 563920 | 1670 | 1689 | TGTGACCATCTAAAATTGAT | 34 | 10642 | 10661 | 2331 |
| 563921 | 1671 | 1690 | TTGTGACCATCTAAAATTGA | 20 | 10643 | 10662 | 2332 |
| 563922 | 1672 | 1691 | ATTGTGACCATCTAAAATTG | 2 | 10644 | 10663 | 2333 |
| 563923 | 1673 | 1692 | GATTGTGACCATCTAAAATT | 43 | 10645 | 10664 | 2334 |
| 563924 | 1674 | 1693 | AGATTGTGACCATCTAAAAT | 39 | 10646 | 10665 | 2335 |
| 563925 | 1675 | 1694 | TAGATTGTGACCATCTAAAA | 36 | 10647 | 10666 | 2336 |
| 563926 | 1676 | 1695 | CTAGATTGTGACCATCTAAA | 56 | 10648 | 10667 | 2337 |
| 563927 | 1677 | 1696 | TCTAGATTGTGACCATCTAA | 37 | 10649 | 10668 | 2338 |
| 563928 | 1678 | 1697 | ATCTAGATTGTGACCATCTA | 46 | 10650 | 10669 | 2339 |
| 563929 | 1679 | 1698 | AATCTAGATTGTGACCATCT | 56 | 10651 | 10670 | 2340 |
| 563930 | 1680 | 1699 | TAATCTAGATTGTGACCATC | 46 | 10652 | 10671 | 2341 |

TABLE 11-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 563931 | 1681 | 1700 | ATAATCTAGATTGTGACCAT | 35 | 10653 | 10672 | 2342 |
| 563932 | 1682 | 1701 | TATAATCTAGATTGTGACCA | 45 | 10654 | 10673 | 2343 |
| 563933 | 1683 | 1702 | TTATAATCTAGATTGTGACC | 37 | 10655 | 10674 | 2344 |
| 563934 | 1686 | 1705 | TGATTATAATCTAGATTGTG | 28 | 10658 | 10677 | 2345 |
| 563935 | 1687 | 1706 | TTGATTATAATCTAGATTGT | 0 | 10659 | 10678 | 2346 |
| 563936 | 1688 | 1707 | ATTGATTATAATCTAGATTG | 0 | 10660 | 10679 | 2347 |
| 563937 | 1689 | 1708 | TATTGATTATAATCTAGATT | 0 | 10661 | 10680 | 2348 |
| 563938 | 1690 | 1709 | CTATTGATTATAATCTAGAT | 5 | 10662 | 10681 | 2349 |
| 563939 | 1691 | 1710 | CCTATTGATTATAATCTAGA | 0 | 10663 | 10682 | 2350 |
| 563940 | 1692 | 1711 | ACCTATTGATTATAATCTAG | 9 | 10664 | 10683 | 2351 |
| 563941 | 1693 | 1712 | CACCTATTGATTATAATCTA | 5 | 10665 | 10684 | 2352 |
| 563942 | 1694 | 1713 | TCACCTATTGATTATAATCT | 0 | 10666 | 10685 | 2353 |
| 563943 | 1695 | 1714 | TTCACCTATTGATTATAATC | 10 | 10667 | 10686 | 2354 |
| 563944 | 1696 | 1715 | GTTCACCTATTGATTATAAT | 31 | 10668 | 10687 | 2355 |
| 563945 | 1697 | 1716 | AGTTCACCTATTGATTATAA | 15 | 10669 | 10688 | 2356 |
| 563946 | 1698 | 1717 | AAGTTCACCTATTGATTATA | 31 | 10670 | 10689 | 2357 |
| 563947 | 1700 | 1719 | ATAAGTTCACCTATTGATTA | 9 | 10672 | 10691 | 2358 |
| 563948 | 1701 | 1720 | AATAAGTTCACCTATTGATT | 5 | 10673 | 10692 | 2359 |
| 563949 | 1702 | 1721 | TAATAAGTTCACCTATTGAT | 14 | 10674 | 10693 | 2360 |
| 563950 | 1703 | 1722 | TTAATAAGTTCACCTATTGA | 0 | 10675 | 10694 | 2361 |

TABLE 12

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 567064 | N/A | N/A | TGAGTATTCTCGACTTACCT | 26 | 8770 | 8789 | 2362 |
| 567065 | N/A | N/A | AAGTGAGTATTCTCGACTTA | 2 | 8773 | 8792 | 2363 |
| 567066 | N/A | N/A | ATTAAGTGAGTATTCTCGAC | 20 | 8776 | 8795 | 2364 |
| 567067 | N/A | N/A | CCAGAATTAAGTGAGTATTC | 36 | 8781 | 8800 | 2365 |
| 567068 | N/A | N/A | GCTTTCTTACCAGAATTAAG | 75 | 8790 | 8809 | 84 |
| 567069 | N/A | N/A | GTTGCTTTCTTACCAGAATT | 78 | 8793 | 8812 | 85 |
| 567070 | N/A | N/A | TGGGTTGCTTTCTTACCAGA | 26 | 8796 | 8815 | 2366 |
| 567071 | N/A | N/A | AAATGGGTTGCTTTCTTACC | 3 | 8799 | 8818 | 2367 |
| 567072 | N/A | N/A | TACAAATGGGTTGCTTTCTT | 24 | 8802 | 8821 | 2368 |

TABLE 12-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 567073 | N/A | N/A | AAGTACAAATGGGTTGCTTT | 24 | 8805 | 8824 | 2369 |
| 567074 | N/A | N/A | GTAAATACAAGTACAAATGG | 7 | 8813 | 8832 | 2370 |
| 567075 | N/A | N/A | TTGCTGGTAAATACAAGTAC | 24 | 8819 | 8838 | 2371 |
| 567076 | N/A | N/A | TAAGGATTGCTGGTAAATAC | 6 | 8825 | 8844 | 2372 |
| 567077 | N/A | N/A | TTTTAAGGATTGCTGGTAAA | 4 | 8828 | 8847 | 2373 |
| 567078 | N/A | N/A | GCTTCATTTTAAGGATTGCT | 60 | 8834 | 8853 | 87 |
| 567079 | N/A | N/A | GAAGCTTCATTTTAAGGATT | 0 | 8837 | 8856 | 2374 |
| 567080 | N/A | N/A | TAGGAAGCTTCATTTTAAGG | 9 | 8840 | 8859 | 2375 |
| 567081 | N/A | N/A | TAGTAGGAAGCTTCATTTTA | 18 | 8843 | 8862 | 2376 |
| 567082 | N/A | N/A | TTGAGTTAGTAGGAAGCTTC | 30 | 8849 | 8868 | 2377 |
| 567083 | N/A | N/A | ATTGCTATTGAGTTAGTAGG | 21 | 8856 | 8875 | 2378 |
| 567084 | N/A | N/A | CTTATTGCTATTGAGTTAGT | 28 | 8859 | 8878 | 2379 |
| 567085 | N/A | N/A | ATTGTCTTATTGCTATTGAG | 16 | 8864 | 8883 | 2380 |
| 567086 | N/A | N/A | ACTATTGTCTTATTGCTATT | 10 | 8867 | 8886 | 2381 |
| 567087 | N/A | N/A | TTCACTATTGTCTTATTGCT | 35 | 8870 | 8889 | 2382 |
| 567088 | N/A | N/A | ACATTCACTATTGTCTTATT | 30 | 8873 | 8892 | 2383 |
| 567089 | N/A | N/A | TAAACATTCACTATTGTCTT | 58 | 8876 | 8895 | 2384 |
| 567090 | N/A | N/A | CATTAAACATTCACTATTGT | 28 | 8879 | 8898 | 2385 |
| 567091 | N/A | N/A | GTTTTCATTAAACATTCACT | 54 | 8884 | 8903 | 2386 |
| 567092 | N/A | N/A | AAATACTGTTTTCATTAAAC | 34 | 8891 | 8910 | 2387 |
| 567093 | N/A | N/A | AAAGTATTTATAAAATACTG | 0 | 8903 | 8922 | 2388 |
| 567094 | N/A | N/A | CCTTTTTATTAAAGTATTTA | 0 | 8913 | 8932 | 2389 |
| 567095 | N/A | N/A | CAATCCTTTTTATTAAAGTA | 10 | 8917 | 8936 | 2390 |
| 567096 | N/A | N/A | CTTCATCACAATCCTTTTTA | 52 | 8925 | 8944 | 2391 |
| 567097 | N/A | N/A | GTTCTTCATCACAATCCTTT | 57 | 8928 | 8947 | 2392 |
| 567098 | N/A | N/A | ATTGTTCTTCATCACAATCC | 37 | 8931 | 8950 | 2393 |
| 567099 | N/A | N/A | TAGATTGTTCTTCATCACAA | 31 | 8934 | 8953 | 2394 |
| 567100 | N/A | N/A | AAATAGATTGTTCTTCATCA | 11 | 8937 | 8956 | 2395 |
| 567101 | N/A | N/A | AACAAATATAAATAGATTGT | 0 | 8946 | 8965 | 2396 |
| 567102 | N/A | N/A | CAAATAACAAATATAAATAG | 3 | 8951 | 8970 | 2397 |
| 567103 | N/A | N/A | TGGAATTAAAAACAAATAAC | 3 | 8963 | 8982 | 2398 |
| 567104 | N/A | N/A | TTATTGGAATTAAAAACAAA | 12 | 8967 | 8986 | 2399 |
| 567105 | N/A | N/A | TTTTTATTGGAATTAAAAAC | 17 | 8970 | 8989 | 2400 |
| 567106 | N/A | N/A | TAATAACTTTTTTCTGTAAT | 6 | 9001 | 9020 | 2401 |
| 567107 | N/A | N/A | GTTCTTAATAACTTTTTTCT | 21 | 9006 | 9025 | 2402 |

TABLE 12-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 567108 | N/A | N/A | AAAAGCATGGTTCTTAATAA | 0 | 9015 | 9034 | 2403 |
| 567109 | N/A | N/A | AAATTTAAAAGCATGGTTCT | 0 | 9021 | 9040 | 2404 |
| 567110 | N/A | N/A | AGGAATAAATTTAAAAAATC | 0 | 9046 | 9065 | 2405 |
| 567111 | N/A | N/A | AGACAGGAATAAATTTAAAA | 7 | 9050 | 9069 | 2406 |
| 567112 | N/A | N/A | AAAAGACAGGAATAAATTTA | 0 | 9053 | 9072 | 2407 |
| 567113 | N/A | N/A | CTTTCTTTGTAGAAAAAGAC | 29 | 9066 | 9085 | 2408 |
| 567114 | N/A | N/A | ATGCTTTCTTTGTAGAAAAA | 12 | 9069 | 9088 | 2409 |
| 567115 | N/A | N/A | GCTTAATGTATGCTTTCTTT | 67 | 9078 | 9097 | 88 |
| 567116 | N/A | N/A | TTTGCTTAATGTATGCTTTC | 21 | 9081 | 9100 | 2410 |
| 567117 | N/A | N/A | GTATTTGCTTAATGTATGCT | 0 | 9084 | 9103 | 2411 |
| 567118 | N/A | N/A | TTGGTATTTGCTTAATGTAT | 0 | 9087 | 9106 | 2412 |
| 567119 | N/A | N/A | CCTTTGGTATTTGCTTAATG | 35 | 9090 | 9109 | 2413 |
| 567120 | N/A | N/A | TGGCCTTTGGTATTTGCTTA | 0 | 9093 | 9112 | 2414 |
| 567121 | N/A | N/A | TAAACCTGGCCTTTGGTATT | 27 | 9099 | 9118 | 2415 |
| 567122 | N/A | N/A | ATGTAAACCTGGCCTTTGGT | 16 | 9102 | 9121 | 2416 |
| 567123 | N/A | N/A | CAAATGTAAACCTGGCCTTT | 0 | 9105 | 9124 | 2417 |
| 567124 | N/A | N/A | CTTCAAATGTAAACCTGGCC | 25 | 9108 | 9127 | 2418 |
| 567125 | N/A | N/A | TTTCTTCAAATGTAAACCTG | 2 | 9111 | 9130 | 2419 |
| 567126 | N/A | N/A | TGTCACTTTCTTCAAATGTA | 57 | 9117 | 9136 | 2420 |
| 567127 | N/A | N/A | TAATGTCACTTTCTTCAAAT | 6 | 9120 | 9139 | 2421 |
| 567128 | N/A | N/A | AATAATAATGTCACTTTCTT | 3 | 9125 | 9144 | 2422 |
| 567129 | N/A | N/A | GAGTAATAATAATGTCACTT | 18 | 9129 | 9148 | 2423 |
| 567130 | N/A | N/A | GACTTGAGTAATAATAATGT | 1 | 9134 | 9153 | 2424 |
| 567131 | N/A | N/A | CCTAGAGACTTGAGTAATAA | 32 | 9140 | 9159 | 2425 |
| 567132 | N/A | N/A | ATTCCTAGAGACTTGAGTAA | 8 | 9143 | 9162 | 2426 |
| 567133 | N/A | N/A | AAGTATTCCTAGAGACTTGA | 11 | 9147 | 9166 | 2427 |
| 567134 | N/A | N/A | GTTAAGTATTCCTAGAGACT | 61 | 9150 | 9169 | 89 |
| 567135 | N/A | N/A | TGTGTTAAGTATTCCTAGAG | 28 | 9153 | 9172 | 2428 |
| 567136 | N/A | N/A | AGAGATGTGTTAAGTATTCC | 31 | 9158 | 9177 | 2429 |
| 567137 | N/A | N/A | GTCAAGAGATGTGTTAAGTA | 52 | 9162 | 9181 | 2430 |
| 567138 | N/A | N/A | ACAGTCAAGAGATGTGTTAA | 22 | 9165 | 9184 | 2431 |
| 567139 | N/A | N/A | TATACAGTCAAGAGATGTGT | 30 | 9168 | 9187 | 2432 |
| 567140 | N/A | N/A | CCATATACAGTCAAGAGATG | 45 | 9171 | 9190 | 2433 |
| 567141 | N/A | N/A | GTAAGTTGAACTAACTACTG | 9 | 7497 | 7516 | 2434 |
| 567142 | N/A | N/A | TGAGTAAGTTGAACTAACTA | 0 | 7500 | 7519 | 2435 |
| 567143 | N/A | N/A | TAATGAGTAAGTTGAACTAA | 2 | 7503 | 7522 | 2436 |

TABLE 12-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 567144 | N/A | N/A | AGGTTAATCTTCCTAATACG | 18 | 7523 | 7542 | 2437 |
| 567145 | N/A | N/A | ATAACCAGGTTAATCTTCCT | 34 | 7529 | 7548 | 2438 |
| 567146 | N/A | N/A | ATGATAACCAGGTTAATCTT | 13 | 7532 | 7551 | 2439 |
| 567147 | N/A | N/A | AACAATGATAACCAGGTTAA | 7 | 7536 | 7555 | 2440 |
| 567148 | N/A | N/A | TAAAACAATGATAACCAGGT | 45 | 7539 | 7558 | 2441 |
| 567149 | N/A | N/A | GTATAAAACAATGATAACCA | 26 | 7542 | 7561 | 2442 |
| 567150 | N/A | N/A | CGAATACTCATATATATTTC | 25 | 7572 | 7591 | 2443 |
| 567151 | N/A | N/A | ATACGAATACTCATATATAT | 30 | 7575 | 7594 | 2444 |
| 567152 | N/A | N/A | TTTATACGAATACTCATATA | 32 | 7578 | 7597 | 2445 |
| 567153 | N/A | N/A | ATATTTATACGAATACTCAT | 25 | 7581 | 7600 | 2446 |
| 567154 | N/A | N/A | GTATTATATTTATACGAATA | 0 | 7586 | 7605 | 2447 |
| 567155 | N/A | N/A | AAAAGTATTATATTTATACG | 0 | 7590 | 7609 | 2448 |
| 567156 | N/A | N/A | GGTAAAAGTATTATATTTAT | 0 | 7593 | 7612 | 2449 |
| 567157 | N/A | N/A | ACAAGGTAAAAGTATTATAT | 10 | 7597 | 7616 | 2450 |
| 567158 | N/A | N/A | TAAACAAGGTAAAAGTATTA | 11 | 7600 | 7619 | 2451 |
| 567159 | N/A | N/A | ACATAAACAAGGTAAAAGTA | 3 | 7603 | 7622 | 2452 |
| 567160 | N/A | N/A | TTGAGTAAATACATAAACAA | 12 | 7613 | 7632 | 2453 |
| 567161 | N/A | N/A | GAGAATATTGAGTAAATACA | 4 | 7620 | 7639 | 2454 |
| 567162 | N/A | N/A | AAGGAGAATATTGAGTAAAT | 8 | 7623 | 7642 | 2455 |
| 567163 | N/A | N/A | GAAAAGGAGAATATTGAGTA | 3 | 7626 | 7645 | 2456 |
| 567164 | N/A | N/A | GAGGAAAAGGAGAATATTGA | 19 | 7629 | 7648 | 2457 |
| 567165 | N/A | N/A | TTAGAGGAAAAGGAGAATAT | 41 | 7632 | 7651 | 2458 |
| 567166 | N/A | N/A | ATTATTTAGAGGAAAAGGA | 30 | 7638 | 7657 | 2459 |
| 567167 | N/A | N/A | CAGATTATTTTAGAGGAAAA | 9 | 7641 | 7660 | 2460 |
| 567168 | N/A | N/A | CTTCAGATTATTTTAGAGGA | 24 | 7644 | 7663 | 2461 |
| 567169 | N/A | N/A | TAGTCACTTCAGATTATTTT | 38 | 7650 | 7669 | 2462 |
| 567170 | N/A | N/A | TAATAGTCACTTCAGATTAT | 13 | 7653 | 7672 | 2463 |
| 567171 | N/A | N/A | TGATAATAGTCACTTCAGAT | 39 | 7656 | 7675 | 2464 |
| 567172 | N/A | N/A | TATTGATAATAGTCACTTCA | 41 | 7659 | 7678 | 2465 |
| 567173 | N/A | N/A | ACTTATTGATAATAGTCACT | 29 | 7662 | 7681 | 2466 |
| 567174 | N/A | N/A | TAAACTTATTGATAATAGTC | 14 | 7665 | 7684 | 2467 |
| 567175 | N/A | N/A | TAGTAAACTTATTGATAATA | 31 | 7668 | 7687 | 2468 |
| 567176 | N/A | N/A | GCATAGTAAACTTATTGATA | 23 | 7671 | 7690 | 2469 |
| 567177 | N/A | N/A | TTGGCATAGTAAACTTATTG | 21 | 7674 | 7693 | 2470 |
| 567178 | N/A | N/A | ATTTGGCATAGTAAACTTA | 8 | 7677 | 7696 | 2471 |

TABLE 12-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 567179 | N/A | N/A | TGAATTTTGGCATAGTAAAC | 5 | 7680 | 7699 | 2472 |
| 567180 | N/A | N/A | TTAATGAATTTTGGCATAGT | 0 | 7684 | 7703 | 2473 |
| 567181 | N/A | N/A | CAATTAATGAATTTTGGCAT | 39 | 7687 | 7706 | 2474 |
| 567182 | N/A | N/A | AAAGGCAATTAATGAATTTT | 12 | 7692 | 7711 | 2475 |
| 567183 | N/A | N/A | GTGAAAGGCAATTAATGAAT | 28 | 7695 | 7714 | 2476 |
| 567184 | N/A | N/A | TTAAGTGAAAGGCAATTAAT | 7 | 7699 | 7718 | 2477 |
| 567185 | N/A | N/A | AAGTTAAGTGAAAGGCAATT | 25 | 7702 | 7721 | 2478 |
| 567186 | N/A | N/A | CCAAAAGTTAAGTGAAAGGC | 50 | 7706 | 7725 | 2479 |
| 567187 | N/A | N/A | GTCCCAAAAGTTAAGTGAAA | 30 | 7709 | 7728 | 2480 |
| 567188 | N/A | N/A | ATGGTCCCAAAAGTTAAGTG | 39 | 7712 | 7731 | 2481 |
| 567189 | N/A | N/A | ATTATGGTCCCAAAAGTTAA | 19 | 7715 | 7734 | 2482 |
| 567190 | N/A | N/A | TTTATTATGGTCCCAAAAGT | 33 | 7718 | 7737 | 2483 |
| 567191 | N/A | N/A | TTATTATTTATTATGGTCCC | 50 | 7724 | 7743 | 2484 |
| 567192 | N/A | N/A | ATGGCAATACATTTTATTAT | 13 | 7737 | 7756 | 2485 |
| 567193 | N/A | N/A | GTTATGGCAATACATTTTAT | 39 | 7740 | 7759 | 2486 |
| 567194 | N/A | N/A | TAATGTTATGGCAATACATT | 0 | 7744 | 7763 | 2487 |
| 567195 | N/A | N/A | TATTAATGTTATGGCAATAC | 22 | 7747 | 7766 | 2488 |
| 567196 | N/A | N/A | GTTTATTAATGTTATGGCAA | 28 | 7750 | 7769 | 2489 |
| 567197 | N/A | N/A | GTAGTTTATTAATGTTATGG | 20 | 7753 | 7772 | 2490 |
| 567198 | N/A | N/A | AAGGTAGTTTATTAATGTTA | 27 | 7756 | 7775 | 2491 |
| 567199 | N/A | N/A | TGTAAGGTAGTTTATTAATG | 0 | 7759 | 7778 | 2492 |
| 567200 | N/A | N/A | TTTTGTAAGGTAGTTTATTA | 0 | 7762 | 7781 | 2493 |
| 567201 | N/A | N/A | TGGTTTTGTAAGGTAGTTTA | 18 | 7765 | 7784 | 2494 |
| 567202 | N/A | N/A | TGGTGGTTTTGTAAGGTAGT | 0 | 7768 | 7787 | 2495 |
| 567203 | N/A | N/A | AATTGGTGGTTTTGTAAGGT | 11 | 7771 | 7790 | 2496 |
| 567204 | N/A | N/A | TTTAATTGGTGGTTTTGTAA | 0 | 7774 | 7793 | 2497 |
| 567205 | N/A | N/A | TTGATTTAATTGGTGGTTT | 19 | 7779 | 7798 | 2498 |
| 567206 | N/A | N/A | TGTTTGATTTAATTGGTGG | 26 | 7782 | 7801 | 2499 |
| 567207 | N/A | N/A | ATGTAAATAACACTTTTTG | 1 | 7804 | 7823 | 2500 |
| 567208 | N/A | N/A | CAGATGTAAATAACACTTTT | 1 | 7807 | 7826 | 2501 |
| 567209 | N/A | N/A | TGACAGATGTAAATAACACT | 21 | 7810 | 7829 | 2502 |
| 567210 | N/A | N/A | ATGTTGACAGATGTAAATAA | 0 | 7814 | 7833 | 2503 |
| 567211 | N/A | N/A | TTTATGTTGACAGATGTAAA | 0 | 7817 | 7836 | 2504 |
| 567212 | N/A | N/A | AGATTTATGTTGACAGATGT | 0 | 7820 | 7839 | 2505 |
| 567213 | N/A | N/A | AGTAGATTTATGTTGACAGA | 19 | 7823 | 7842 | 2506 |
| 567214 | N/A | N/A | TTTAGTAGATTTATGTTGAC | 4 | 7826 | 7845 | 2507 |

TABLE 12-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 567215 | N/A | N/A | ATTTTTAGTAGATTTATGTT | 0 | 7829 | 7848 | 2508 |
| 567216 | N/A | N/A | CATGTATTTTAGTAGATTT | 5 | 7834 | 7853 | 2509 |
| 567217 | N/A | N/A | GAAATCATGTATTTTAGTA | 0 | 7839 | 7858 | 2510 |
| 567218 | N/A | N/A | ATTGTATTTGATGGATATCT | 43 | 6875 | 6894 | 2511 |
| 567219 | N/A | N/A | GATACATTGTATTTGATGGA | 20 | 6880 | 6899 | 2512 |
| 567220 | N/A | N/A | TAGGTTGATACATTGTATTT | 18 | 6886 | 6905 | 2513 |
| 567221 | N/A | N/A | CAGTTTAGGTTGATACATTG | 18 | 6891 | 6910 | 2514 |
| 567222 | N/A | N/A | GCATCCAGTTTAGGTTGATA | 31 | 6896 | 6915 | 2515 |
| 567223 | N/A | N/A | CCCCAGCATCCAGTTTAGGT | 14 | 6901 | 6920 | 2516 |
| 567224 | N/A | N/A | AAGAACCCCAGCATCCAGTT | 41 | 6906 | 6925 | 2517 |
| 567225 | N/A | N/A | GTGTAAAAGAACCCCAGCA | 0 | 6913 | 6932 | 2518 |
| 567226 | N/A | N/A | ATAGGGTGTAAAAGAACCC | 13 | 6918 | 6937 | 2519 |
| 567227 | N/A | N/A | CTTTTATAGGGTGTAAAAAG | 0 | 6923 | 6942 | 2520 |
| 567228 | N/A | N/A | TATGTCTTTTATAGGGTGTA | 26 | 6928 | 6947 | 2521 |
| 567229 | N/A | N/A | TTAGGTATGTCTTTTATAGG | 0 | 6933 | 6952 | 2522 |
| 567230 | N/A | N/A | TTGTCTTAGGTATGTCTTTT | 30 | 6938 | 6957 | 2523 |
| 567231 | N/A | N/A | CTCTGATTGTCTTAGGTATG | 27 | 6944 | 6963 | 2524 |
| 567232 | N/A | N/A | TATTTCTCTGATTGTCTTAG | 21 | 6949 | 6968 | 2525 |
| 567233 | N/A | N/A | TCCATATTTGTATTTCTCTG | 61 | 6959 | 6978 | 90 |
| 567234 | N/A | N/A | TCAAGTCCATATTTGTATTT | 20 | 6964 | 6983 | 2526 |
| 567235 | N/A | N/A | AATAATCAAGTCCATATTTG | 0 | 6969 | 6988 | 2527 |
| 567236 | N/A | N/A | TTATCTAATAATCAAGTCCA | 0 | 6975 | 6994 | 2528 |
| 567237 | N/A | N/A | CTATATTATCTAATAATCAA | 12 | 6980 | 6999 | 2529 |
| 567238 | N/A | N/A | TAAACCTTCTATATTATCTA | 12 | 6988 | 7007 | 2530 |
| 567239 | N/A | N/A | AATTAATAAACCTTCTATAT | 0 | 6994 | 7013 | 2531 |
| 567240 | N/A | N/A | TAAGTACAGGTTGGACACTG | 0 | 9504 | 9523 | 2532 |
| 567241 | N/A | N/A | GTTATTAAGTACAGGTTGGA | 2 | 9509 | 9528 | 2533 |
| 567242 | N/A | N/A | TGTGAGTTATTAAGTACAGG | 0 | 9514 | 9533 | 2534 |
| 567243 | N/A | N/A | AAATCTGTGAGTTATTAAGT | 0 | 9519 | 9538 | 2535 |
| 567244 | N/A | N/A | GTTTTAAAAATCTGTGAGTT | 19 | 9526 | 9545 | 2536 |
| 567245 | N/A | N/A | CAAAATTCTCCTGAAAAGAA | 20 | 9548 | 9567 | 2537 |
| 567246 | N/A | N/A | CCCAACCAAAATTCTCCTGA | 48 | 9554 | 9573 | 2538 |
| 567247 | N/A | N/A | ACCTGAATAACCCTCTGGAC | 21 | 9807 | 9826 | 2539 |
| 567248 | N/A | N/A | AAGATACCTGAATAACCCTC | 30 | 9812 | 9831 | 2540 |
| 567249 | N/A | N/A | AGAAAAGATACCTGAATAA | 0 | 9817 | 9836 | 2541 |

TABLE 12-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 567250 | N/A | N/A | TGGTATCAGAAAAAGATACC | 0 | 9824 | 9843 | 2542 |
| 567251 | N/A | N/A | AGTATTGGTATCAGAAAAAG | 0 | 9829 | 9848 | 2543 |
| 567252 | N/A | N/A | AATAAAGTATTGGTATCAGA | 10 | 9834 | 9853 | 2544 |
| 567253 | N/A | N/A | ATGAAAATAAAGTATTGGTA | 3 | 9839 | 9858 | 2545 |
| 567254 | N/A | N/A | AGATACTTTGAAGATATGAA | 0 | 9854 | 9873 | 2546 |
| 567255 | N/A | N/A | TGGGAAGATACTTTGAAGAT | 0 | 9859 | 9878 | 2547 |
| 567256 | N/A | N/A | CTAATAATGTGGGAAGATAC | 0 | 9868 | 9887 | 2548 |
| 567257 | N/A | N/A | CATTGCAGATAATAGCTAAT | 0 | 9883 | 9902 | 2549 |
| 567258 | N/A | N/A | AAGTTGTCATTGCAGATAAT | 0 | 9890 | 9909 | 2550 |
| 567259 | N/A | N/A | TTTTAAAGTTGTCATTGCA | 7 | 9896 | 9915 | 2551 |
| 567260 | N/A | N/A | ATTCGGATTTTAAAAGTTG | 5 | 9904 | 9923 | 2552 |
| 567261 | N/A | N/A | TTATTTGGGATTCGGATTTT | 15 | 9913 | 9932 | 2553 |
| 567262 | N/A | N/A | TTATAGTTAAGAGGTTTTCG | 27 | 9949 | 9968 | 2554 |
| 567263 | N/A | N/A | TTTCATTATAGTTAAGAGGT | 12 | 9954 | 9973 | 2555 |
| 567264 | N/A | N/A | GAACACTTTCATTATAGTTA | 13 | 9960 | 9979 | 2556 |
| 567265 | N/A | N/A | GAACTAGAATGAACACTTTC | 28 | 9970 | 9989 | 2557 |
| 567266 | N/A | N/A | TGATTGAACTAGAATGAACA | 23 | 9975 | 9994 | 2558 |
| 567267 | N/A | N/A | ATACCTGATTGAACTAGAAT | 9 | 9980 | 9999 | 2559 |
| 567268 | N/A | N/A | GTAAAATACCTGATTGAACT | 6 | 9985 | 10004 | 2560 |
| 567269 | N/A | N/A | TAGAGGTAAAATACCTGATT | 16 | 9990 | 10009 | 2561 |
| 567270 | N/A | N/A | AAGATTAGAGGTAAAATACC | 0 | 9995 | 10014 | 2562 |
| 567271 | N/A | N/A | TGAGGAAGATTAGAGGTAAA | 6 | 10000 | 10019 | 2563 |
| 567272 | N/A | N/A | GAAAATCTGAGGAAGATTAG | 0 | 10007 | 10026 | 2564 |
| 567273 | N/A | N/A | AAATAGAAAATCTGAGGAAG | 0 | 10012 | 10031 | 2565 |
| 567274 | N/A | N/A | ATCTATACACTACCAAAAAA | 0 | 10029 | 10048 | 2566 |
| 567275 | N/A | N/A | AAATAATCTATACACTACCA | 19 | 10034 | 10053 | 2567 |
| 567276 | N/A | N/A | AAATAATCTGTATAAATAAT | 3 | 10047 | 10066 | 2568 |
| 567277 | N/A | N/A | CCCAATTTTAAATAATCTGT | 24 | 10056 | 10075 | 2569 |
| 567278 | N/A | N/A | TAAGTCCCAATTTTAAATAA | 0 | 10061 | 10080 | 2570 |
| 567279 | N/A | N/A | TCTGTATAAGTCCCAATTTT | 15 | 10067 | 10086 | 2571 |
| 567280 | N/A | N/A | AATAATCTGTATAAGTCCCA | 47 | 10072 | 10091 | 2572 |
| 567281 | N/A | N/A | AGTTTTAAATAATCTGTATA | 0 | 10079 | 10098 | 2573 |
| 567282 | N/A | N/A | ATCCCAGTTTTAAATAATCT | 6 | 10084 | 10103 | 2574 |
| 567283 | N/A | N/A | CATGTATCCCAGTTTTAAAT | 6 | 10089 | 10108 | 2575 |
| 567284 | N/A | N/A | TAGATGCATGTATCCCAGTT | 41 | 10095 | 10114 | 2576 |
| 567285 | N/A | N/A | TGTTTTAGATGCATGTATCC | 4 | 10100 | 10119 | 2577 |

TABLE 12-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 567286 | N/A | N/A | TACAGTGTTTTAGATGCATG | 25 | 10105 | 10124 | 2578 |
| 567287 | N/A | N/A | AATATTACAGTGTTTTAGAT | 0 | 10110 | 10129 | 2579 |
| 567288 | N/A | N/A | CTTATAAATATTACAGTGTT | 2 | 10116 | 10135 | 2580 |
| 567289 | N/A | N/A | CTTCCTTTCTTATAAATATT | 12 | 10124 | 10143 | 2581 |
| 567290 | N/A | N/A | TTTATCTTCCTTTCTTATAA | 0 | 10129 | 10148 | 2582 |
| 567291 | N/A | N/A | CGTAAGTTTATCTTCCTTTC | 61 | 10135 | 10154 | 91 |
| 567292 | N/A | N/A | TTCCCCGTAAGTTTATCTTC | 22 | 10140 | 10159 | 2583 |
| 567293 | N/A | N/A | TGTATTTCCCCGTAAGTTTA | 0 | 10145 | 10164 | 2584 |
| 567294 | N/A | N/A | GTTACTGTATTTCCCCGTAA | 43 | 10150 | 10169 | 2585 |
| 544120 | 707 | 726 | AGTTCTTGGTGCTCTTGGCT | 80 | 6720 | 6739 | 15 |
| 337487 | 804 | 823 | CACTTGTATGTTCACCTCTG | 80 | 7389 | 7408 | 28 |

TABLE 13

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 563780 | N/A | N/A | TGTTTTCTTCTGGAAGCAGA | 10 | 3100 | 3119 | 2586 |
| 568085 | N/A | N/A | CAGACCTAGACTTCTTAACT | 8 | 3084 | 3103 | 2587 |
| 568086 | N/A | N/A | AGCAGACCTAGACTTCTTAA | 6 | 3086 | 3105 | 2588 |
| 568087 | N/A | N/A | TTTTCTTCTGGAAGCAGACC | 0 | 3098 | 3117 | 2589 |
| 568088 | N/A | N/A | AAACATATATACATGCTTGT | 52 | 11323 | 11342 | 2590 |
| 568089 | N/A | N/A | TTAAACATATATACATGCTT | 39 | 11325 | 11344 | 2591 |
| 568090 | N/A | N/A | GTTTATTGAATTTTAAACAT | 0 | 11337 | 11356 | 2592 |
| 568091 | N/A | N/A | TTGTTTATTGAATTTTAAAC | 9 | 11339 | 11358 | 2593 |
| 568092 | N/A | N/A | CTTTGTTTATTGAATTTTAA | 0 | 11341 | 11360 | 2594 |
| 568093 | N/A | N/A | GTCTTTGTTTATTGAATTTT | 28 | 11343 | 11362 | 2595 |
| 568094 | N/A | N/A | GGGTCTTTGTTTATTGAATT | 0 | 11345 | 11364 | 2596 |
| 568095 | N/A | N/A | CTGGGTCTTTGTTTATTGAA | 11 | 11347 | 11366 | 2597 |
| 568096 | N/A | N/A | GACTGGGTCTTTGTTTATTG | 35 | 11349 | 11368 | 2598 |
| 568097 | N/A | N/A | TTTCTATAATTTAGGGACTG | 12 | 11364 | 11383 | 2599 |
| 568098 | N/A | N/A | AATTTCTATAATTTAGGGAC | 0 | 11366 | 11385 | 2600 |
| 568099 | N/A | N/A | TAAATTTCTATAATTTAGGG | 5 | 11368 | 11387 | 2601 |
| 568100 | N/A | N/A | CAAGAATAATTTAAATTTCT | 38 | 11379 | 11398 | 2602 |

TABLE 13-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 568101 | N/A | N/A | GATAAACATGCAAGAATAAT | 1 | 11389 | 11408 | 2603 |
| 568102 | N/A | N/A | TCGATAAACATGCAAGAATA | 51 | 11391 | 11410 | 2604 |
| 568103 | N/A | N/A | TGTCGATAAACATGCAAGAA | 37 | 11393 | 11412 | 2605 |
| 568104 | N/A | N/A | GATGTCGATAAACATGCAAG | 57 | 11395 | 11414 | 2606 |
| 568105 | N/A | N/A | GTGATGTCGATAAACATGCA | 61 | 11397 | 11416 | 2607 |
| 568106 | N/A | N/A | TTGTGATGTCGATAAACATG | 57 | 11399 | 11418 | 2608 |
| 568107 | N/A | N/A | TGTTGTGATGTCGATAAACA | 47 | 11401 | 11420 | 2609 |
| 568108 | N/A | N/A | TCTGTTGTGATGTCGATAAA | 53 | 11403 | 11422 | 2610 |
| 568109 | N/A | N/A | GATCTGTTGTGATGTCGATA | 36 | 11405 | 11424 | 2611 |
| 568110 | N/A | N/A | GGGATCTGTTGTGATGTCGA | 41 | 11407 | 11426 | 2612 |
| 568111 | N/A | N/A | TAGGGATCTGTTGTGATGTC | 43 | 11409 | 11428 | 2613 |
| 568112 | N/A | N/A | TTTAGGGATCTGTTGTGATG | 18 | 11411 | 11430 | 2614 |
| 568113 | N/A | N/A | GATTTAGGGATCTGTTGTGA | 41 | 11413 | 11432 | 2615 |
| 568114 | N/A | N/A | ATCTAATCTTTAGGGATTTA | 37 | 11435 | 11454 | 2616 |
| 568115 | N/A | N/A | TTTGTATCTAATCTTTAGGG | 28 | 11440 | 11459 | 2617 |
| 568116 | N/A | N/A | AATTTGTATCTAATCTTTAG | 0 | 11442 | 11461 | 2618 |
| 568117 | N/A | N/A | GTGGTAAAAATTTGTATCT | 13 | 11451 | 11470 | 2619 |
| 568118 | N/A | N/A | CTGTGGTAAAAATTTGTAT | 5 | 11453 | 11472 | 2620 |
| 568119 | N/A | N/A | TACTGTGGTAAAAATTTGT | 10 | 11455 | 11474 | 2621 |
| 568120 | N/A | N/A | GATACTGTGGTAAAAATTT | 17 | 11457 | 11476 | 2622 |
| 568121 | N/A | N/A | AGTGATACTGTGGTAAAAA | 38 | 11460 | 11479 | 2623 |
| 568122 | N/A | N/A | CAAGTGATACTGTGGTAAAA | 58 | 11462 | 11481 | 2624 |
| 568123 | N/A | N/A | GACAAGTGATACTGTGGTAA | 52 | 11464 | 11483 | 2625 |
| 568124 | N/A | N/A | CTGACAAGTGATACTGTGGT | 62 | 11466 | 11485 | 2626 |
| 568125 | N/A | N/A | TTCTGACAAGTGATACTGTG | 27 | 11468 | 11487 | 2627 |
| 568126 | N/A | N/A | AATTCTGACAAGTGATACTG | 33 | 11470 | 11489 | 2628 |
| 568127 | N/A | N/A | ATAAATTCTGACAAGTGATA | 38 | 11473 | 11492 | 2629 |
| 568128 | N/A | N/A | CTGGCAGTTTTAAAAAATCA | 28 | 11502 | 11521 | 2630 |
| 568129 | N/A | N/A | TTCTTACTGGCAGTTTTAAA | 56 | 11508 | 11527 | 2631 |
| 568130 | N/A | N/A | ATTTCTTACTGGCAGTTTTA | 47 | 11510 | 11529 | 2632 |
| 568131 | N/A | N/A | AAATTTCTTACTGGCAGTTT | 53 | 11512 | 11531 | 2633 |
| 568132 | N/A | N/A | TTTAAAATTTCTTACTGGCA | 46 | 11516 | 11535 | 2634 |
| 568133 | N/A | N/A | TTAATTTAAAATTTCTTACT | 9 | 11520 | 11539 | 2635 |
| 568134 | N/A | N/A | CAAATGGGTTTAATTTAAAA | 1 | 11529 | 11548 | 2636 |
| 568135 | N/A | N/A | AACAAATGGGTTTAATTTAA | 11 | 11531 | 11550 | 2637 |
| 568136 | N/A | N/A | TTAACAAATGGGTTTAATTT | 12 | 11533 | 11552 | 2638 |

TABLE 13-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 568137 | N/A | N/A | CTTTAACAAATGGGTTTAAT | 27 | 11535 | 11554 | 2639 |
| 568138 | N/A | N/A | TCCTTTAACAAATGGGTTTA | 52 | 11537 | 11556 | 2640 |
| 568139 | N/A | N/A | CTATATCCTTTAACAAATGG | 24 | 11542 | 11561 | 2641 |
| 568140 | N/A | N/A | GGGCACTATATCCTTTAACA | 45 | 11547 | 11566 | 2642 |
| 568141 | N/A | N/A | TTGGGCACTATATCCTTTAA | 20 | 11549 | 11568 | 2643 |
| 568142 | N/A | N/A | TATAACTTGGGCACTATATC | 27 | 11555 | 11574 | 2644 |
| 568143 | N/A | N/A | CATATAACTTGGGCACTATA | 40 | 11557 | 11576 | 2645 |
| 568144 | N/A | N/A | ACCATATAACTTGGGCACTA | 69 | 11559 | 11578 | 103 |
| 568145 | N/A | N/A | TCACCATATAACTTGGGCAC | 60 | 11561 | 11580 | 2646 |
| 568146 | N/A | N/A | GGTCACCATATAACTTGGGC | 73 | 11563 | 11582 | 104 |
| 568147 | N/A | N/A | TAGGTCACCATATAACTTGG | 51 | 11565 | 11584 | 2647 |
| 568148 | N/A | N/A | GGTAGGTCACCATATAACTT | 57 | 11567 | 11586 | 2648 |
| 568149 | N/A | N/A | AAGGTAGGTCACCATATAAC | 52 | 11569 | 11588 | 2649 |
| 568150 | N/A | N/A | CAAAGGTAGGTCACCATATA | 28 | 11571 | 11590 | 2650 |
| 568151 | N/A | N/A | GACAAAGGTAGGTCACCATA | 67 | 11573 | 11592 | 105 |
| 568152 | N/A | N/A | GTATTGACAAAGGTAGGTCA | 55 | 11578 | 11597 | 2651 |
| 568153 | N/A | N/A | AAGTATTGACAAAGGTAGGT | 36 | 11580 | 11599 | 2652 |
| 568154 | N/A | N/A | CTAAGTATTGACAAAGGTAG | 24 | 11582 | 11601 | 2653 |
| 568155 | N/A | N/A | TGCTAAGTATTGACAAAGGT | 49 | 11584 | 11603 | 2654 |
| 568156 | N/A | N/A | AATGCTAAGTATTGACAAAG | 10 | 11586 | 11605 | 2655 |
| 568157 | N/A | N/A | CATAATGCTAAGTATTGACA | 19 | 11589 | 11608 | 2656 |
| 568158 | N/A | N/A | TACATAATGCTAAGTATTGA | 4 | 11591 | 11610 | 2657 |
| 568159 | N/A | N/A | AATACATAATGCTAAGTATT | 1 | 11593 | 11612 | 2658 |
| 568160 | N/A | N/A | GAAATACATAATGCTAAGTA | 23 | 11595 | 11614 | 2659 |
| 568161 | N/A | N/A | TTTGAAATACATAATGCTAA | 8 | 11598 | 11617 | 2660 |
| 568162 | N/A | N/A | GGATAATTTGAAATACATAA | 16 | 11604 | 11623 | 2661 |
| 568163 | N/A | N/A | TTGGATAATTTGAAATACAT | 0 | 11606 | 11625 | 2662 |
| 568164 | N/A | N/A | TATTGGATAATTTGAAATAC | 0 | 11608 | 11627 | 2663 |
| 568165 | N/A | N/A | ATCCAGTTAAAGCTTGTAAA | 46 | 4466 | 4485 | 2664 |
| 568166 | N/A | N/A | TCATGATCCAGTTAAAGCTT | 32 | 4471 | 4490 | 2665 |
| 568167 | N/A | N/A | TTTACTCATGATCCAGTTAA | 24 | 4476 | 4495 | 2666 |
| 568168 | N/A | N/A | GATAATTTTACTCATGATCC | 53 | 4482 | 4501 | 2667 |
| 568169 | N/A | N/A | GATGTGATAATTTTACTCAT | 27 | 4487 | 4506 | 2668 |
| 568170 | N/A | N/A | ATGCTGATGTGATAATTTTA | 42 | 4492 | 4511 | 2669 |
| 568171 | N/A | N/A | CAGTTATGCTGATGTGATAA | 0 | 4497 | 4516 | 2670 |

TABLE 13-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 568172 | N/A | N/A | TTTAACAGTTATGCTGATGT | 17 | 4502 | 4521 | 2671 |
| 568173 | N/A | N/A | GCAATTTTAACAGTTATGCT | 11 | 4507 | 4526 | 2672 |
| 568174 | N/A | N/A | AGAGCCTGCAATTTTAACAG | 25 | 4514 | 4533 | 2673 |
| 568175 | N/A | N/A | GCTTCAGAGCCTGCAATTTT | 47 | 4519 | 4538 | 2674 |
| 568176 | N/A | N/A | TATTAGCTTCAGAGCCTGCA | 48 | 4524 | 4543 | 2675 |
| 568177 | N/A | N/A | TAGTTTATTAGCTTCAGAGC | 20 | 4529 | 4548 | 2676 |
| 568178 | N/A | N/A | GCAGGTAGTTTATTAGCTTC | 39 | 4534 | 4553 | 2677 |
| 568179 | N/A | N/A | TAAATGCAGGTAGTTTATTA | 0 | 4539 | 4558 | 2678 |
| 568180 | N/A | N/A | ATGGTTTAAATGCAGGTAGT | 20 | 4545 | 4564 | 2679 |
| 568181 | N/A | N/A | GAGCCATGGTTTAAATGCAG | 33 | 4550 | 4569 | 2680 |
| 568182 | N/A | N/A | TTTTAGAGCCATGGTTTAAA | 40 | 4555 | 4574 | 2681 |
| 568183 | N/A | N/A | CAAAGTTTTAGAGCCATGGT | 54 | 4560 | 4579 | 2682 |
| 568184 | N/A | N/A | TCACACAAAGTTTTAGAGCC | 61 | 4565 | 4584 | 2683 |
| 568185 | N/A | N/A | CAAGGTCACACAAAGTTTTA | 17 | 4570 | 4589 | 2684 |
| 568186 | N/A | N/A | GGGTGAAGTAATTTATTCAA | 0 | 4587 | 4606 | 2685 |
| 568187 | N/A | N/A | GTGAGGAAACTGAGAGATAA | 12 | 4609 | 4628 | 2686 |
| 568188 | N/A | N/A | TGTAGTATATGTGAGGAAAC | 38 | 4619 | 4638 | 2687 |
| 568189 | N/A | N/A | ATCTTTGTAGTATATGTGAG | 30 | 4624 | 4643 | 2688 |
| 568190 | N/A | N/A | TTATTATCTTTGTAGTATAT | 19 | 4629 | 4648 | 2689 |
| 568191 | N/A | N/A | TTCTGTTATTATCTTTGTAG | 48 | 4634 | 4653 | 2690 |
| 568192 | N/A | N/A | ATAAGTTCTGTTATTATCTT | 16 | 4639 | 4658 | 2691 |
| 568193 | N/A | N/A | ATCCTATAAGTTCTGTTATT | 22 | 4644 | 4663 | 2692 |
| 568194 | N/A | N/A | CAATAATCCTATAAGTTCTG | 0 | 4649 | 4668 | 2693 |
| 568195 | N/A | N/A | TAAGATGACATTGGCTGCTA | 49 | 4689 | 4708 | 2694 |
| 568196 | N/A | N/A | TTTAGTAAGATGACATTGGC | 32 | 4694 | 4713 | 2695 |
| 568197 | N/A | N/A | TTGAATTTAGTAAGATGAC | 19 | 4700 | 4719 | 2696 |
| 568198 | N/A | N/A | CTAATTTGAATTTTAGTAAG | 34 | 4705 | 4724 | 2697 |
| 568199 | N/A | N/A | CATGATCTAATTTGAATTTT | 29 | 4711 | 4730 | 2698 |
| 568200 | N/A | N/A | CAAAGAGAAACATGATCTAA | 27 | 4721 | 4740 | 2699 |
| 568201 | N/A | N/A | GTTTTGAGCAAAGAGAAACA | 36 | 4729 | 4748 | 2700 |
| 568202 | N/A | N/A | GTGTGGTTTTGAGCAAAGAG | 3 | 4734 | 4753 | 2701 |
| 568203 | N/A | N/A | AGCTATTGTGTGGTTTTGAG | 13 | 4741 | 4760 | 2702 |
| 568204 | N/A | N/A | TGAAATGGAAAGCTATTGTG | 15 | 4751 | 4770 | 2703 |
| 568205 | N/A | N/A | TATGAGTGAAATGGAAAGCT | 27 | 4757 | 4776 | 2704 |
| 568206 | N/A | N/A | GCCAATATGAGTGAAATGGA | 62 | 4762 | 4781 | 106 |
| 568207 | N/A | N/A | AAAGAGCCAATATGAGTGAA | 25 | 4767 | 4786 | 2705 |

TABLE 13-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 568208 | N/A | N/A | TTGGTCTAAAGAGCCAATAT | 42 | 4774 | 4793 | 2706 |
| 568209 | N/A | N/A | GGTAATCTTGGTCTAAAGAG | 29 | 4781 | 4800 | 2707 |
| 568210 | N/A | N/A | GTGAGATGACGAAGGGTTGG | 0 | 4800 | 4819 | 2708 |
| 568211 | N/A | N/A | AGTCAGTGAGATGACGAAGG | 5 | 4805 | 4824 | 2709 |
| 568212 | N/A | N/A | GGTGAAGTCAGTGAGATGAC | 12 | 4810 | 4829 | 2710 |
| 568213 | N/A | N/A | GTAGAGGAGGTGAAGTCAGT | 13 | 4818 | 4837 | 2711 |
| 568214 | N/A | N/A | AACTAGAGTAGAGGAGGTGA | 20 | 4825 | 4844 | 2712 |
| 568215 | N/A | N/A | AGAATAACTAGAGTAGAGGA | 33 | 4830 | 4849 | 2713 |
| 568216 | N/A | N/A | CGGTCAGAATAACTAGAGTA | 39 | 4835 | 4854 | 2714 |
| 568217 | N/A | N/A | TAAAGCGGTCAGAATAACTA | 29 | 4840 | 4859 | 2715 |
| 568218 | N/A | N/A | ACTGGTAAAGCGGTCAGAAT | 17 | 4845 | 4864 | 2716 |
| 568219 | N/A | N/A | TGAATACTGGTAAAGCGGTC | 37 | 4850 | 4869 | 2717 |
| 568220 | N/A | N/A | TGTGTTTGAATACTGGTAAA | 21 | 4856 | 4875 | 2718 |
| 568221 | N/A | N/A | AGTATGTTTGATGTGTTTGA | 25 | 4867 | 4886 | 2719 |
| 568222 | N/A | N/A | GTGGCAGTATGTTTGATGTG | 15 | 4872 | 4891 | 2720 |
| 568223 | N/A | N/A | TTGAGGTGGCAGTATGTTTG | 14 | 4877 | 4896 | 2721 |
| 568224 | N/A | N/A | AGGCTTTGAGGTGGCAGTAT | 33 | 4882 | 4901 | 2722 |
| 568225 | N/A | N/A | GGCAAAGGCTTTGAGGTGGC | 27 | 4887 | 4906 | 2723 |
| 568226 | N/A | N/A | AACAAGGGCAAAGGCTTTGA | 24 | 4893 | 4912 | 2724 |
| 568227 | N/A | N/A | TAGAGGAAACAACAAGGGCA | 24 | 4903 | 4922 | 2725 |
| 568228 | N/A | N/A | CCAGTTAGAGGAAACAACAA | 4 | 4908 | 4927 | 2726 |
| 568229 | N/A | N/A | GATACCAGGGCAGAAGAGCG | 24 | 4930 | 4949 | 2727 |
| 568230 | N/A | N/A | AAATCAGAGAGTGGGCCACG | 24 | 4952 | 4971 | 2728 |
| 568231 | N/A | N/A | CCTAAGGGAAATCAGAGAGT | 19 | 4960 | 4979 | 2729 |
| 568232 | N/A | N/A | ACGACCCTAAGGGAAATCAG | 30 | 4965 | 4984 | 2730 |
| 568233 | N/A | N/A | TGATAACGACCCTAAGGGAA | 0 | 4970 | 4989 | 2731 |
| 568234 | N/A | N/A | TTTTGTTTGATAACGACCCT | 22 | 4977 | 4996 | 2732 |
| 568235 | N/A | N/A | GTCTTCATTGGGAATTTTTT | 37 | 4993 | 5012 | 2733 |
| 568236 | N/A | N/A | TGTAAGTCTTCATTGGGAAT | 23 | 4998 | 5017 | 2734 |
| 568237 | N/A | N/A | GACCTTGTAAGTCTTCATTG | 52 | 5003 | 5022 | 2735 |
| 568238 | N/A | N/A | TAAGTGACCTTGTAAGTCTT | 36 | 5008 | 5027 | 2736 |
| 568239 | N/A | N/A | TTGGTTAAGTGACCTTGTAA | 11 | 5013 | 5032 | 2737 |
| 568240 | N/A | N/A | TGATTTTGGTTAAGTGACC | 12 | 5019 | 5038 | 2738 |
| 568241 | N/A | N/A | GGTTGTGATTTTGGTTAAG | 11 | 5024 | 5043 | 2739 |
| 568242 | N/A | N/A | CAGGCGGTTGTGATTTTGG | 41 | 5029 | 5048 | 2740 |

TABLE 13-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 568243 | N/A | N/A | GGGACCAGGCGGTTGTGATT | 22 | 5034 | 5053 | 2741 |
| 568244 | N/A | N/A | CTAAGGAAGTAGAAGTTTTC | 42 | 5060 | 5079 | 2742 |
| 568245 | N/A | N/A | AGTAGCTAAGGAAGTAGAAG | 11 | 5065 | 5084 | 2743 |
| 568246 | N/A | N/A | CAGGAGAAAAGTAGCTAAGG | 36 | 5074 | 5093 | 2744 |
| 568247 | N/A | N/A | GTGTGCAGGAGAAAAGTAGC | 14 | 5079 | 5098 | 2745 |
| 568248 | N/A | N/A | TAAAGGTGAGTGTGCAGGAG | 7 | 5088 | 5107 | 2746 |
| 568249 | N/A | N/A | ATGTTAAATAAAGGTGAGTG | 8 | 5096 | 5115 | 2747 |
| 568250 | N/A | N/A | ATGTTATGTTAAATAAAGGT | 27 | 5101 | 5120 | 2748 |
| 568251 | N/A | N/A | AATTTATGTTATGTTAAATA | 27 | 5106 | 5125 | 2749 |
| 568252 | N/A | N/A | TAACTAAAATTTATGTTATG | 28 | 5113 | 5132 | 2750 |
| 568253 | N/A | N/A | GATAAATAACTAAAATTTAT | 32 | 5119 | 5138 | 2751 |
| 568254 | N/A | N/A | TTTAGTGCAGGAATAGAAGA | 33 | 5139 | 5158 | 2752 |
| 568255 | N/A | N/A | AATCCCTGTATTCACAGAGC | 68 | 5165 | 5184 | 2753 |
| 568256 | N/A | N/A | GAAAAAATCCCTGTATTCAC | 0 | 5170 | 5189 | 2754 |
| 568257 | N/A | N/A | TAATGGAAAAAATCCCTGTA | 8 | 5175 | 5194 | 2755 |
| 568258 | N/A | N/A | AAATATGAAGATAATGGAAA | 26 | 5186 | 5205 | 2756 |
| 568259 | N/A | N/A | ATAATGGAAAATATGAAGAT | 18 | 5194 | 5213 | 2757 |
| 568260 | N/A | N/A | TATACAAATAATGGAAAATA | 30 | 5201 | 5220 | 2758 |
| 568261 | N/A | N/A | TTCTGGAGTATATACAAATA | 45 | 5211 | 5230 | 2759 |
| 568262 | N/A | N/A | ATTCTATATTCTGGAGTATA | 40 | 5219 | 5238 | 2760 |
| 568263 | N/A | N/A | CCATACAGTATTCTATATTC | 57 | 5228 | 5247 | 2761 |
| 568264 | N/A | N/A | CTGTGTGCCATACAGTATTC | 28 | 5235 | 5254 | 2762 |
| 568265 | N/A | N/A | GCCTACTGTGTGCCATACAG | 60 | 5240 | 5259 | 2763 |
| 568266 | N/A | N/A | AGAAATGCCTACTGTGTGCC | 42 | 5246 | 5265 | 2764 |
| 568267 | N/A | N/A | TCAACAGAAATGCCTACTGT | 52 | 5251 | 5270 | 2765 |
| 568268 | N/A | N/A | ATTAATTCAACAGAAATGCC | 46 | 5257 | 5276 | 2766 |
| 568269 | N/A | N/A | GACATTACATTTATTAATTC | 32 | 5269 | 5288 | 2767 |
| 568270 | N/A | N/A | GTGAATATGACATTACATTT | 32 | 5277 | 5296 | 2768 |
| 568271 | N/A | N/A | CTTCTGTGTGAATATGACAT | 50 | 5284 | 5303 | 2769 |
| 568272 | N/A | N/A | ACACGCTTCTGTGTGAATAT | 43 | 5289 | 5308 | 2770 |
| 568273 | N/A | N/A | ATAGCACACGCTTCTGTGTG | 31 | 5294 | 5313 | 2771 |
| 568274 | N/A | N/A | TAATCATAGCACACGCTTCT | 40 | 5299 | 5318 | 2772 |
| 568275 | N/A | N/A | AATAATAATCATAGCACACG | 20 | 5304 | 5323 | 2773 |
| 568276 | N/A | N/A | CCAAGTAATAATAATCATAG | 35 | 5310 | 5329 | 2774 |
| 568277 | N/A | N/A | CTAGTAATCCAAGTAATAAT | 38 | 5318 | 5337 | 2775 |
| 568278 | N/A | N/A | TATTTCTAGTAATCCAAGTA | 39 | 5323 | 5342 | 2776 |

TABLE 13-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 568279 | N/A | N/A | CACACTATTTCTAGTAATCC | 51 | 5328 | 5347 | 2777 |
| 568280 | N/A | N/A | TTATGAGGCACACTATTTCT | 25 | 5336 | 5355 | 2778 |
| 568281 | N/A | N/A | TTTAATTATGAGGCACACTA | 35 | 5341 | 5360 | 2779 |
| 568282 | N/A | N/A | GTTGACCTTTAATTATGAGG | 63 | 5348 | 5367 | 2780 |
| 568283 | N/A | N/A | TTACATTGTTGAATGTTGAC | 45 | 5362 | 5381 | 2781 |
| 568284 | N/A | N/A | ATTAATTACATTGTTGAATG | 31 | 5367 | 5386 | 2782 |
| 568285 | N/A | N/A | TGTAGATTAATTACATTGTT | 49 | 5372 | 5391 | 2783 |
| 568286 | N/A | N/A | TACATTGTAGATTAATTACA | 43 | 5377 | 5396 | 2784 |
| 568287 | N/A | N/A | AGATGTTTACATTGTAGATT | 28 | 5384 | 5403 | 2785 |
| 568288 | N/A | N/A | TTCACCAGATGTTTACATTG | 36 | 5390 | 5409 | 2786 |
| 568289 | N/A | N/A | GTCACTTCACCAGATGTTTA | 65 | 5395 | 5414 | 2787 |
| 568290 | N/A | N/A | CCTCTGTCACTTCACCAGAT | 67 | 5400 | 5419 | 2788 |
| 568291 | N/A | N/A | GCTTCCCTCTGTCACTTCAC | 70 | 5405 | 5424 | 2789 |
| 568292 | N/A | N/A | CAAGTGCTTCCCTCTGTCAC | 33 | 5410 | 5429 | 2790 |
| 568293 | N/A | N/A | TTTCTAAACAAGTGCTTCCC | 70 | 5418 | 5437 | 107 |
| 568294 | N/A | N/A | GCTTTTTTCTAAACAAGTGC | 45 | 5423 | 5442 | 2791 |
| 568295 | N/A | N/A | ACATAGCTTTTTTCTAAACA | 9 | 5428 | 5447 | 2792 |
| 568296 | N/A | N/A | TTCTGACATAGCTTTTTTCT | 23 | 5433 | 5452 | 2793 |
| 568297 | N/A | N/A | ATGGATTCTGACATAGCTTT | 46 | 5438 | 5457 | 2794 |
| 568298 | N/A | N/A | AATACATGGATTCTGACATA | 37 | 5443 | 5462 | 2795 |
| 568299 | N/A | N/A | ATTAGAATACATGGATTCTG | 57 | 5448 | 5467 | 2796 |
| 568300 | N/A | N/A | CTGCATATTAGAATACATGG | 75 | 5454 | 5473 | 108 |
| 568301 | N/A | N/A | TTGTACTGCATATTAGAATA | 53 | 5459 | 5478 | 2797 |
| 568302 | N/A | N/A | AACTATTGTACTGCATATTA | 25 | 5464 | 5483 | 2798 |
| 568303 | N/A | N/A | TTTTAAACTATTGTACTGCA | 25 | 5469 | 5488 | 2799 |
| 568304 | N/A | N/A | TGAGAGTATTATTAATATTT | 8 | 5487 | 5506 | 2800 |
| 568305 | N/A | N/A | GCTGTTTGAGAGTATTATTA | 50 | 5493 | 5512 | 2801 |
| 568306 | N/A | N/A | GAATAGCTGTTTGAGAGTAT | 38 | 5498 | 5517 | 2802 |
| 568307 | N/A | N/A | CCTCTTGAATAGCTGTTTGA | 55 | 5504 | 5523 | 2803 |
| 568308 | N/A | N/A | TGAATCCTCTTGAATAGCTG | 55 | 5509 | 5528 | 2804 |
| 568309 | N/A | N/A | TTTTTTGAATCCTCTTGAAT | 46 | 5514 | 5533 | 2805 |
| 568310 | N/A | N/A | TTATGTTTTTTGAATCCTCT | 36 | 5519 | 5538 | 2806 |
| 568311 | N/A | N/A | GTTTATATTATGTTTTTTGA | 6 | 5526 | 5545 | 2807 |
| 568312 | N/A | N/A | TCTGAGTTTATATTATGTTT | 29 | 5531 | 5550 | 2808 |
| 568313 | N/A | N/A | CAGTTTCTCTGAGTTTATAT | 28 | 5538 | 5557 | 2809 |

TABLE 13-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 568314 | N/A | N/A | GTTTACCAGTTTCTCTGAGT | 44 | 5544 | 5563 | 2810 |
| 568315 | N/A | N/A | ATTTTGTTTACCAGTTTCTC | 58 | 5549 | 5568 | 2811 |
| 568316 | N/A | N/A | AAATGATTTTGTTTACCAGT | 29 | 5554 | 5573 | 2812 |
| 568317 | N/A | N/A | CTCTTGAAAATGATTTTGTT | 22 | 5561 | 5580 | 2813 |
| 568318 | N/A | N/A | TATATCTCTTGAAAATGATT | 5 | 5566 | 5585 | 2814 |
| 568319 | N/A | N/A | CAGGTTGGCAAGTTTGTTTG | 27 | 6175 | 6194 | 2815 |
| 568320 | N/A | N/A | GTTGGCAGGTTGGCAAGTTT | 44 | 6180 | 6199 | 2816 |
| 568321 | N/A | N/A | ATATCTGTAGATGTTGGCAG | 59 | 6192 | 6211 | 2817 |
| 568322 | N/A | N/A | TAAACATATCTGTAGATGTT | 18 | 6197 | 6216 | 2818 |
| 568323 | N/A | N/A | ACCTGTAAACATATCTGTAG | 57 | 6202 | 6221 | 2819 |
| 568324 | N/A | N/A | TTTTGACCTGTAAACATATC | 23 | 6207 | 6226 | 2820 |
| 568325 | N/A | N/A | ATAATTTTGACCTGTAAAC | 7 | 6212 | 6231 | 2821 |
| 568326 | N/A | N/A | TAATTTGATAATTTTTGACC | 7 | 6219 | 6238 | 2822 |
| 568327 | N/A | N/A | TTCTTGATAATTTGATAATT | 8 | 6226 | 6245 | 2823 |
| 568328 | N/A | N/A | ACCAGGCTTTCTTGATAATT | 55 | 6234 | 6253 | 2824 |
| 568329 | N/A | N/A | TTTGAACCAGGCTTTCTTGA | 49 | 6239 | 6258 | 2825 |
| 568330 | N/A | N/A | CATAATTTGAACCAGGCTTT | 68 | 6244 | 6263 | 109 |
| 568331 | N/A | N/A | AGACATAATACATAATTTGA | 8 | 6254 | 6273 | 2826 |
| 568332 | N/A | N/A | CTGTGATAAAGACATAATAC | 40 | 6263 | 6282 | 2827 |
| 568333 | N/A | N/A | CAGACCTGTGATAAAGACAT | 16 | 6268 | 6287 | 2828 |
| 568334 | N/A | N/A | ATCTTCAGACCTGTGATAAA | 7 | 6273 | 6292 | 2829 |
| 568335 | N/A | N/A | TACTGATCTTCAGACCTGTG | 47 | 6278 | 6297 | 2830 |
| 568336 | N/A | N/A | TTAATAATTTTCAGTTTTAG | 35 | 6302 | 6321 | 2831 |
| 568337 | N/A | N/A | TAAGTTTAATAATTTTCAGT | 23 | 6307 | 6326 | 2832 |
| 568338 | N/A | N/A | TTCAGATTTAAGTTTAATA | 10 | 6316 | 6335 | 2833 |
| 568339 | N/A | N/A | TATATTTGATATTCTGTTCA | 42 | 6332 | 6351 | 2834 |
| 568340 | N/A | N/A | ATATTGTAATGTATTCTTTT | 0 | 6368 | 6387 | 2835 |
| 568341 | N/A | N/A | TTAGAATATTGTAATGTATT | 19 | 6373 | 6392 | 2836 |
| 568342 | N/A | N/A | TTTGCTTAGAATATTGTAAT | 9 | 6378 | 6397 | 2837 |
| 568343 | N/A | N/A | ACTGCTTTGCTTAGAATATT | 36 | 6383 | 6402 | 2838 |
| 568344 | N/A | N/A | AAGTAGAGACTGCTTTGCTT | 60 | 6391 | 6410 | 2839 |
| 568345 | N/A | N/A | GCAAGGCCAAAAGTAGAGAC | 59 | 6401 | 6420 | 2840 |
| 568346 | N/A | N/A | ACAGAGCAAGGCCAAAAGTA | 45 | 6406 | 6425 | 2841 |
| 568347 | N/A | N/A | GGAAAACAGAGCAAGGCCAA | 49 | 6411 | 6430 | 2842 |
| 568348 | N/A | N/A | TGGTCGGAAAACAGAGCAAG | 38 | 6416 | 6435 | 2843 |
| 568349 | N/A | N/A | GACATTGGTCGGAAAACAGA | 26 | 6421 | 6440 | 2844 |

TABLE 13-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 568350 | N/A | N/A | AAGCAGACATTGGTCGGAAA | 50 | 6426 | 6445 | 2845 |
| 568351 | N/A | N/A | CAAGGCAAAAAGCAGACAT | 39 | 6436 | 6455 | 2846 |
| 568352 | N/A | N/A | ATAAAGCAAGGCAAAAAGC | 20 | 6442 | 6461 | 2847 |
| 568353 | N/A | N/A | CATTATTTAATAAGATAAAA | 29 | 6464 | 6483 | 2848 |
| 568354 | N/A | N/A | AAATATTTAATCAGGGACAT | 35 | 6481 | 6500 | 2849 |
| 568355 | N/A | N/A | TGTTCTCAAAATATTTAATC | 32 | 6489 | 6508 | 2850 |
| 568356 | N/A | N/A | GATTACCTGTTCTCAAAATA | 40 | 6496 | 6515 | 2851 |
| 568357 | N/A | N/A | GATTGTACAGATTACCTGTT | 12 | 6505 | 6524 | 2852 |
| 568358 | N/A | N/A | ATTCAGATTGTACAGATTAC | 34 | 6510 | 6529 | 2853 |
| 568359 | N/A | N/A | AAACAGTGTTATTCAGATTG | 32 | 6520 | 6539 | 2854 |
| 568360 | N/A | N/A | TAGATAAACAGTGTTATTCA | 25 | 6525 | 6544 | 2855 |
| 568361 | N/A | N/A | ATATTTAGATAAACAGTGTT | 14 | 6530 | 6549 | 2856 |
| 568362 | N/A | N/A | GTTTGATATTTAGATAAACA | 27 | 6535 | 6554 | 2857 |
| 568363 | N/A | N/A | AACGGTGTTTGATATTTAGA | 33 | 6541 | 6560 | 2858 |
| 568364 | N/A | N/A | GTTATAACGGTGTTTGATAT | 29 | 6546 | 6565 | 2859 |
| 568365 | N/A | N/A | ATAATGTTATAACGGTGTTT | 21 | 6551 | 6570 | 2860 |
| 568366 | N/A | N/A | AGTTCATAATGTTATAACGG | 37 | 6556 | 6575 | 2861 |
| 568367 | N/A | N/A | CTTTCAGTTCATAATGTTAT | 46 | 6561 | 6580 | 2862 |
| 568368 | N/A | N/A | AGTACAGTTTGTCTTTCAGT | 48 | 6573 | 6592 | 2863 |
| 568369 | N/A | N/A | TCAGAAGTACAGTTTGTCTT | 47 | 6578 | 6597 | 2864 |
| 568370 | N/A | N/A | GGATGTCAGAAGTACAGTTT | 46 | 6583 | 6602 | 2865 |
| 568371 | N/A | N/A | GAGTAAGGATGTCAGAAGTA | 45 | 6589 | 6608 | 2866 |
| 568372 | N/A | N/A | GAAATCTGAGTAAGGATGTC | 31 | 6596 | 6615 | 2867 |
| 568373 | N/A | N/A | TACTGAATATACAATTAGGG | 5 | 6616 | 6635 | 2868 |
| 568374 | N/A | N/A | AATGATACTGAATATACAAT | 21 | 6621 | 6640 | 2869 |
| 568375 | N/A | N/A | GAATATAAATCTGTTTTTA | 19 | 6642 | 6661 | 2870 |
| 568376 | N/A | N/A | TAAAAGAATATAAATCTGTT | 32 | 6647 | 6666 | 2871 |
| 568377 | N/A | N/A | GCTGATAAAGAATATAAAT | 50 | 6652 | 6671 | 2872 |
| 568378 | N/A | N/A | CCTTCTGAGCTGATAAAGA | 37 | 6660 | 6679 | 2873 |
| 568379 | N/A | N/A | CTAGTCCTTCTGAGCTGATA | 45 | 6665 | 6684 | 2874 |
| 568380 | N/A | N/A | TTACCATCATGTTTTACATT | 30 | 6770 | 6789 | 2875 |
| 568381 | N/A | N/A | CAAAGTGTCTTACCATCATG | 24 | 6779 | 6798 | 2876 |
| 568382 | N/A | N/A | AAACCCACCAAAGTGTCTTA | 15 | 6787 | 6806 | 2877 |
| 568383 | N/A | N/A | AGAAGGAAACCCACCAAAGT | 22 | 6793 | 6812 | 2878 |
| 568384 | N/A | N/A | AATAATAGCTTCAAGAAGGA | 25 | 6806 | 6825 | 2879 |

TABLE 13-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 568385 | N/A | N/A | AATTTGATAATAATAGCTTC | 24 | 6814 | 6833 | 2880 |
| 568386 | N/A | N/A | TAGGGAATTTGATAATAATA | 20 | 6819 | 6838 | 2881 |
| 568387 | N/A | N/A | AAGAATAGGGAATTTGATAA | 0 | 6824 | 6843 | 2882 |
| 568388 | N/A | N/A | GTCCTAAGAATAGGGAATTT | 45 | 6829 | 6848 | 2883 |
| 568389 | N/A | N/A | TAGAACAAGTCCTAAGAATA | 21 | 6837 | 6856 | 2884 |
| 568390 | N/A | N/A | TTAGTCTAGAACAAGTCCTA | 28 | 6843 | 6862 | 2885 |
| 568391 | N/A | N/A | ATCTTTTAGTCTAGAACAAG | 21 | 6848 | 6867 | 2886 |
| 568392 | N/A | N/A | TAACTATCTTTTAGTCTAGA | 13 | 6853 | 6872 | 2887 |
| 568393 | N/A | N/A | ATCTCTTAACTATCTTTTAG | 28 | 6859 | 6878 | 2888 |
| 568394 | N/A | N/A | TGGATATCTCTTAACTATCT | 48 | 6864 | 6883 | 2889 |
| 568395 | N/A | N/A | TTTGATGGATATCTCTTAAC | 35 | 6869 | 6888 | 2890 |
| 544120 | 707 | 726 | AGTTCTTGGTGCTCTTGGCT | 80 | 6720 | 6739 | 15 |
| 337487 | 804 | 823 | CACTTGTATGTTCACCTCTG | 76 | 7389 | 7408 | 28 |
| 568006 | 2014 | 2033 | TTAATTCTGCTTCATTAGGT | 53 | 10986 | 11005 | 2891 |
| 568007 | 2015 | 2034 | TTTAATTCTGCTTCATTAGG | 38 | 10987 | 11006 | 2892 |
| 568008 | 2020 | 2039 | CAGTATTTAATTCTGCTTCA | 56 | 10992 | 11011 | 2893 |
| 568009 | 2021 | 2040 | ACAGTATTTAATTCTGCTTC | 63 | 10993 | 11012 | 2894 |
| 568010 | 2022 | 2041 | TACAGTATTTAATTCTGCTT | 56 | 10994 | 11013 | 2895 |
| 568011 | 2023 | 2042 | ATACAGTATTTAATTCTGCT | 39 | 10995 | 11014 | 2896 |
| 568012 | 2024 | 2043 | AATACAGTATTTAATTCTGC | 21 | 10996 | 11015 | 2897 |
| 568013 | 2025 | 2044 | TAATACAGTATTTAATTCTG | 12 | 10997 | 11016 | 2898 |
| 568014 | 2027 | 2046 | TTTAATACAGTATTTAATTC | 0 | 10999 | 11018 | 2899 |
| 568015 | 2028 | 2047 | TTTTAATACAGTATTTAATT | 15 | 11000 | 11019 | 2900 |
| 568016 | 2031 | 2050 | TTATTTTAATACAGTATTTA | 0 | 11003 | 11022 | 2901 |
| 568017 | 2034 | 2053 | AACTTATTTTAATACAGTAT | 24 | 11006 | 11025 | 2902 |
| 568018 | 2035 | 2054 | GAACTTATTTTAATACAGTA | 21 | 11007 | 11026 | 2903 |
| 568019 | 2036 | 2055 | CGAACTTATTTTAATACAGT | 2 | 11008 | 11027 | 2904 |
| 568020 | 2037 | 2056 | GCGAACTTATTTTAATACAG | 54 | 11009 | 11028 | 2905 |
| 568021 | 2038 | 2057 | AGCGAACTTATTTTAATACA | 35 | 11010 | 11029 | 2906 |
| 568022 | 2039 | 2058 | CAGCGAACTTATTTTAATAC | 50 | 11011 | 11030 | 2907 |
| 568023 | 2040 | 2059 | ACAGCGAACTTATTTTAATA | 34 | 11012 | 11031 | 2908 |
| 568024 | 2041 | 2060 | GACAGCGAACTTATTTTAAT | 52 | 11013 | 11032 | 2909 |
| 568025 | 2042 | 2061 | AGACAGCGAACTTATTTTAA | 58 | 11014 | 11033 | 2910 |
| 568026 | 2044 | 2063 | AAAGACAGCGAACTTATTTT | 32 | 11016 | 11035 | 2911 |
| 568027 | 2045 | 2064 | TAAAGACAGCGAACTTATTT | 26 | 11017 | 11036 | 2912 |
| 568028 | 2048 | 2067 | GTTTAAAGACAGCGAACTTA | 62 | 11020 | 11039 | 2913 |

TABLE 13-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 568029 | 2049 | 2068 | TGTTTAAAGACAGCGAACTT | 58 | 11021 | 11040 | 2914 |
| 568030 | 2050 | 2069 | TTGTTTAAAGACAGCGAACT | 52 | 11022 | 11041 | 2915 |
| 568031 | 2051 | 2070 | TTTGTTTAAAGACAGCGAAC | 61 | 11023 | 11042 | 2916 |
| 568032 | 2052 | 2071 | ATTTGTTTAAAGACAGCGAA | 41 | 11024 | 11043 | 2917 |
| 568033 | 2053 | 2072 | CATTTGTTTAAAGACAGCGA | 60 | 11025 | 11044 | 2918 |
| 568034 | 2054 | 2073 | CCATTTGTTTAAAGACAGCG | 88 | 11026 | 11045 | 98 |
| 568035 | 2055 | 2074 | TCCATTTGTTTAAAGACAGC | 57 | 11027 | 11046 | 2919 |
| 568036 | 2056 | 2075 | CTCCATTTGTTTAAAGACAG | 58 | 11028 | 11047 | 2920 |
| 568037 | 2058 | 2077 | ATCTCCATTTGTTTAAAGAC | 56 | 11030 | 11049 | 2921 |
| 568038 | 2059 | 2078 | CATCTCCATTTGTTTAAAGA | 54 | 11031 | 11050 | 2922 |
| 568039 | 2060 | 2079 | TCATCTCCATTTGTTTAAAG | 62 | 11032 | 11051 | 2923 |
| 568040 | 2061 | 2080 | GTCATCTCCATTTGTTTAAA | 53 | 11033 | 11052 | 2924 |
| 568041 | 2063 | 2082 | TAGTCATCTCCATTTGTTTA | 48 | 11035 | 11054 | 2925 |
| 568042 | 2064 | 2083 | GTAGTCATCTCCATTTGTTT | 44 | 11036 | 11055 | 2926 |
| 568043 | 2065 | 2084 | AGTAGTCATCTCCATTTGTT | 48 | 11037 | 11056 | 2927 |
| 568044 | 2066 | 2085 | TAGTAGTCATCTCCATTTGT | 45 | 11038 | 11057 | 2928 |
| 568045 | 2067 | 2086 | TTAGTAGTCATCTCCATTTG | 66 | 11039 | 11058 | 2929 |
| 568046 | 2068 | 2087 | CTTAGTAGTCATCTCCATTT | 66 | 11040 | 11059 | 2930 |
| 568047 | 2069 | 2088 | ACTTAGTAGTCATCTCCATT | 68 | 11041 | 11060 | 99 |
| 568048 | 2070 | 2089 | GACTTAGTAGTCATCTCCAT | 77 | 11042 | 11061 | 100 |
| 568049 | 2071 | 2090 | TGACTTAGTAGTCATCTCCA | 70 | 11043 | 11062 | 101 |
| 568050 | 2072 | 2091 | GTGACTTAGTAGTCATCTCC | 65 | 11044 | 11063 | 2931 |
| 568051 | 2073 | 2092 | TGTGACTTAGTAGTCATCTC | 49 | 11045 | 11064 | 2932 |
| 568052 | 2074 | 2093 | ATGTGACTTAGTAGTCATCT | 47 | 11046 | 11065 | 2933 |
| 568053 | 2075 | 2094 | AATGTGACTTAGTAGTCATC | 48 | 11047 | 11066 | 2934 |
| 568054 | 2076 | 2095 | CAATGTGACTTAGTAGTCAT | 60 | 11048 | 11067 | 2935 |
| 568055 | 2077 | 2096 | TCAATGTGACTTAGTAGTCA | 54 | 11049 | 11068 | 2936 |
| 568056 | 2078 | 2097 | GTCAATGTGACTTAGTAGTC | 72 | 11050 | 11069 | 102 |
| 568057 | 2079 | 2098 | AGTCAATGTGACTTAGTAGT | 62 | 11051 | 11070 | 2937 |
| 568058 | 2083 | 2102 | TTAAAGTCAATGTGACTTAG | 15 | 11055 | 11074 | 2938 |
| 568059 | 2084 | 2103 | GTTAAAGTCAATGTGACTTA | 28 | 11056 | 11075 | 2939 |
| 568060 | 2085 | 2104 | TGTTAAAGTCAATGTGACTT | 35 | 11057 | 11076 | 2940 |
| 568061 | 2086 | 2105 | ATGTTAAAGTCAATGTGACT | 17 | 11058 | 11077 | 2941 |
| 568062 | 2087 | 2106 | CATGTTAAAGTCAATGTGAC | 27 | 11059 | 11078 | 2942 |
| 568063 | 2089 | 2108 | CTCATGTTAAAGTCAATGTG | 28 | 11061 | 11080 | 2943 |

TABLE 13-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 568064 | 2090 | 2109 | CCTCATGTTAAAGTCAATGT | 50 | 11062 | 11081 | 2944 |
| 568066 | 2091 | 2110 | ACCTCATGTTAAAGTCAATG | 48 | 11063 | 11082 | 2945 |
| 568068 | 2092 | 2111 | TACCTCATGTTAAAGTCAAT | 13 | 11064 | 11083 | 2946 |
| 568069 | 2093 | 2112 | ATACCTCATGTTAAAGTCAA | 43 | 11065 | 11084 | 2947 |
| 568072 | 2094 | 2113 | GATACCTCATGTTAAAGTCA | 40 | 11066 | 11085 | 2948 |
| 568073 | 2095 | 2114 | TGATACCTCATGTTAAAGTC | 40 | 11067 | 11086 | 2949 |
| 568075 | 2096 | 2115 | GTGATACCTCATGTTAAAGT | 37 | 11068 | 11087 | 2950 |
| 568077 | 2097 | 2116 | AGTGATACCTCATGTTAAAG | 6 | 11069 | 11088 | 2951 |
| 568078 | 2098 | 2117 | TAGTGATACCTCATGTTAAA | 12 | 11070 | 11089 | 2952 |
| 568079 | 2099 | 2118 | ATAGTGATACCTCATGTTAA | 8 | 11071 | 11090 | 2953 |
| 568080 | 2100 | 2119 | TATAGTGATACCTCATGTTA | 13 | 11072 | 11091 | 2954 |
| 568081 | 2101 | 2120 | GTATAGTGATACCTCATGTT | 41 | 11073 | 11092 | 2955 |
| 568082 | 2102 | 2121 | GGTATAGTGATACCTCATGT | 53 | 11074 | 11093 | 2956 |
| 568083 | 2106 | 2125 | ATAAGGTATAGTGATACCTC | 54 | 11078 | 11097 | 2957 |
| 568084 | 2107 | 2126 | AATAAGGTATAGTGATACCT | 38 | 11079 | 11098 | 2958 |

TABLE 14

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544120 | 707 | 726 | AGTTCTTGGTGCTCTTGGCT | 83 | 6720 | 6739 | 15 |
| 337487 | 804 | 823 | CACTTGTATGTTCACCTCTG | 81 | 7389 | 7408 | 28 |
| 567295 | 1452 | 1471 | TAATGTTTAAATTATTGCCT | 43 | 10424 | 10443 | 2959 |
| 567296 | 1455 | 1474 | GGTTAATGTTTAAATTATTG | 22 | 10427 | 10446 | 2960 |
| 567297 | 1456 | 1475 | AGGTTAATGTTTAAATTATT | 0 | 10428 | 10447 | 2961 |
| 567298 | 1457 | 1476 | GAGGTTAATGTTTAAATTAT | 0 | 10429 | 10448 | 2962 |
| 567299 | 1458 | 1477 | TGAGGTTAATGTTTAAATTA | 6 | 10430 | 10449 | 2963 |
| 567300 | 1460 | 1479 | AATGAGGTTAATGTTTAAAT | 14 | 10432 | 10451 | 2964 |
| 567301 | 1461 | 1480 | GAATGAGGTTAATGTTTAAA | 5 | 10433 | 10452 | 2965 |
| 567302 | 1462 | 1481 | GGAATGAGGTTAATGTTTAA | 27 | 10434 | 10453 | 2966 |
| 567303 | 1463 | 1482 | TGGAATGAGGTTAATGTTTA | 32 | 10435 | 10454 | 2967 |
| 567304 | 1464 | 1483 | TTGGAATGAGGTTAATGTTT | 37 | 10436 | 10455 | 2968 |
| 567305 | 1465 | 1484 | CTTGGAATGAGGTTAATGTT | 25 | 10437 | 10456 | 2969 |
| 567306 | 1468 | 1487 | TAACTTGGAATGAGGTTAAT | 29 | 10440 | 10459 | 2970 |

TABLE 14-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 567307 | 1469 | 1488 | TTAACTTGGAATGAGGTTAA | 44 | 10441 | 10460 | 2971 |
| 337513 | 1470 | 1489 | ATTAACTTGGAATGAGGTTA | 52 | 10442 | 10461 | 2972 |
| 567308 | 1471 | 1490 | CATTAACTTGGAATGAGGTT | 62 | 10443 | 10462 | 2973 |
| 567309 | 1472 | 1491 | ACATTAACTTGGAATGAGGT | 58 | 10444 | 10463 | 2974 |
| 567310 | 1473 | 1492 | CACATTAACTTGGAATGAGG | 78 | 10445 | 10464 | 92 |
| 567311 | 1475 | 1494 | ACCACATTAACTTGGAATGA | 59 | 10447 | 10466 | 2975 |
| 567312 | 1476 | 1495 | GACCACATTAACTTGGAATG | 57 | 10448 | 10467 | 2976 |
| 337514 | 1477 | 1496 | AGACCACATTAACTTGGAAT | 71 | 10449 | 10468 | 2977 |
| 567313 | 1478 | 1497 | TAGACCACATTAACTTGGAA | 43 | 10450 | 10469 | 2978 |
| 567314 | 1479 | 1498 | TTAGACCACATTAACTTGGA | 59 | 10451 | 10470 | 2979 |
| 567315 | 1480 | 1499 | ATTAGACCACATTAACTTGG | 70 | 10452 | 10471 | 2980 |
| 567316 | 1481 | 1500 | TATTAGACCACATTAACTTG | 53 | 10453 | 10472 | 2981 |
| 567317 | 1482 | 1501 | TTATTAGACCACATTAACTT | 49 | 10454 | 10473 | 2982 |
| 567318 | 1483 | 1502 | ATTATTAGACCACATTAACT | 41 | 10455 | 10474 | 2983 |
| 567319 | 1484 | 1503 | GATTATTAGACCACATTAAC | 47 | 10456 | 10475 | 2984 |
| 567320 | 1487 | 1506 | CCAGATTATTAGACCACATT | 86 | 10459 | 10478 | 93 |
| 567321 | 1489 | 1508 | TACCAGATTATTAGACCACA | 85 | 10461 | 10480 | 94 |
| 337516 | 1490 | 1509 | ATACCAGATTATTAGACCAC | 77 | 10462 | 10481 | 86 |
| 567322 | 1491 | 1510 | AATACCAGATTATTAGACCA | 50 | 10463 | 10482 | 2985 |
| 567323 | 1492 | 1511 | TAATACCAGATTATTAGACC | 56 | 10464 | 10483 | 2986 |
| 567324 | 1494 | 1513 | TTTAATACCAGATTATTAGA | 9 | 10466 | 10485 | 2987 |
| 567325 | 1495 | 1514 | ATTTAATACCAGATTATTAG | 24 | 10467 | 10486 | 2988 |
| 567326 | 1496 | 1515 | GATTTAATACCAGATTATTA | 37 | 10468 | 10487 | 2989 |
| 567327 | 1500 | 1519 | TAAGGATTTAATACCAGATT | 60 | 10472 | 10491 | 2990 |
| 567328 | 1507 | 1526 | TTTCTCTTAAGGATTTAATA | 34 | 10479 | 10498 | 2991 |
| 567329 | 1508 | 1527 | CTTTCTCTTAAGGATTTAAT | 46 | 10480 | 10499 | 2992 |
| 567330 | 1509 | 1528 | GCTTTCTCTTAAGGATTTAA | 75 | 10481 | 10500 | 95 |
| 567331 | 1510 | 1529 | AGCTTTCTCTTAAGGATTTA | 59 | 10482 | 10501 | 2993 |
| 567332 | 1511 | 1530 | AAGCTTTCTCTTAAGGATTT | 30 | 10483 | 10502 | 2994 |
| 567333 | 1513 | 1532 | TCAAGCTTTCTCTTAAGGAT | 65 | 10485 | 10504 | 2995 |
| 567334 | 1514 | 1533 | CTCAAGCTTTCTCTTAAGGA | 77 | 10486 | 10505 | 96 |
| 567335 | 1515 | 1534 | TCTCAAGCTTTCTCTTAAGG | 75 | 10487 | 10506 | 97 |
| 567336 | 1516 | 1535 | TTCTCAAGCTTTCTCTTAAG | 59 | 10488 | 10507 | 2996 |
| 567337 | 1517 | 1536 | TTTCTCAAGCTTTCTCTTAA | 52 | 10489 | 10508 | 2997 |
| 567338 | 1521 | 1540 | TCTATTTCTCAAGCTTTCTC | 68 | 10493 | 10512 | 2998 |

TABLE 14-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 567339 | 1522 | 1541 | ATCTATTTCTCAAGCTTTCT | 71 | 10494 | 10513 | 2999 |
| 567340 | 1523 | 1542 | AATCTATTTCTCAAGCTTTC | 74 | 10495 | 10514 | 3000 |
| 567341 | 1524 | 1543 | AAATCTATTTCTCAAGCTTT | 63 | 10496 | 10515 | 3001 |
| 567342 | 1525 | 1544 | AAAATCTATTTCTCAAGCTT | 54 | 10497 | 10516 | 3002 |
| 567343 | 1532 | 1551 | GATAAAAAAATCTATTTCT | 30 | 10504 | 10523 | 3003 |
| 567344 | 1548 | 1567 | TAGACAGTGACTTTAAGATA | 37 | 10520 | 10539 | 3004 |
| 567345 | 1549 | 1568 | ATAGACAGTGACTTTAAGAT | 29 | 10521 | 10540 | 3005 |
| 567346 | 1550 | 1569 | AATAGACAGTGACTTTAAGA | 48 | 10522 | 10541 | 3006 |
| 567347 | 1551 | 1570 | AAATAGACAGTGACTTTAAG | 26 | 10523 | 10542 | 3007 |
| 567348 | 1552 | 1571 | TAAATAGACAGTGACTTTAA | 26 | 10524 | 10543 | 3008 |
| 567349 | 1553 | 1572 | TTAAATAGACAGTGACTTTA | 50 | 10525 | 10544 | 3009 |
| 567350 | 1554 | 1573 | CTTAAATAGACAGTGACTTT | 63 | 10526 | 10545 | 3010 |
| 567351 | 1555 | 1574 | TCTTAAATAGACAGTGACTT | 57 | 10527 | 10546 | 3011 |
| 567352 | 1556 | 1575 | ATCTTAAATAGACAGTGACT | 69 | 10528 | 10547 | 3012 |
| 567353 | 1557 | 1576 | AATCTTAAATAGACAGTGAC | 40 | 10529 | 10548 | 3013 |
| 567354 | 1558 | 1577 | TAATCTTAAATAGACAGTGA | 30 | 10530 | 10549 | 3014 |
| 567355 | 1559 | 1578 | TTAATCTTAAATAGACAGTG | 25 | 10531 | 10550 | 3015 |
| 567356 | 1560 | 1579 | TTTAATCTTAAATAGACAGT | 0 | 10532 | 10551 | 3016 |
| 567357 | 1561 | 1580 | GTTTAATCTTAAATAGACAG | 34 | 10533 | 10552 | 3017 |
| 567358 | 1562 | 1581 | TGTTTAATCTTAAATAGACA | 5 | 10534 | 10553 | 3018 |
| 567359 | 1563 | 1582 | ATGTTTAATCTTAAATAGAC | 0 | 10535 | 10554 | 3019 |
| 567360 | 1567 | 1586 | TTGTATGTTTAATCTTAAAT | 0 | 10539 | 10558 | 3020 |
| 567361 | 1568 | 1587 | ATTGTATGTTTAATCTTAAA | 8 | 10540 | 10559 | 3021 |
| 567362 | 1569 | 1588 | GATTGTATGTTTAATCTTAA | 20 | 10541 | 10560 | 3022 |
| 567363 | 1570 | 1589 | TGATTGTATGTTTAATCTTA | 29 | 10542 | 10561 | 3023 |
| 567364 | 1574 | 1593 | TATGTGATTGTATGTTTAAT | 7 | 10546 | 10565 | 3024 |
| 567365 | 1576 | 1595 | GTTATGTGATTGTATGTTTA | 43 | 10548 | 10567 | 3025 |
| 567366 | 1580 | 1599 | TAAGGTTATGTGATTGTATG | 28 | 10552 | 10571 | 3026 |
| 567367 | 1581 | 1600 | TTAAGGTTATGTGATTGTAT | 31 | 10553 | 10572 | 3027 |
| 567368 | 1585 | 1604 | TTCTTTAAGGTTATGTGATT | 12 | 10557 | 10576 | 3028 |

Example 2: Dose-Dependent Antisense Inhibition of Human ANGPTL3 in Hep3B Cells by MOE Gapmers 5-10-5 MOE gapmers from the studies described above exhibiting significant in vitro inhibition of ANGPTL3 mRNA were selected and tested at various doses in Hep3B cells. Cells were plated at a density of 20,000 cells per well and transfected using electroporation with 0.75 µM, 1.50 µM, 3.00 µM, 6.00 µM and 12.00 µM concentrations of antisense oligonucleotide, as specified in the Table below. After a treatment period of approximately 16 hours, RNA was isolated from the cells and ANGPTL3 mRNA levels were measured by quantitative real-time PCR. Human primer probe set RTS3492_MGB was used to measure mRNA levels. ANGPTL3 mRNA levels were adjusted according to total RNA content, as measured by RIBOGREEN®. Results are presented as percent inhibition of ANGPTL3, relative to untreated control cells.

The half maximal inhibitory concentration (IC$_{50}$) of each oligonucleotide is also presented. ANGPTL3 mRNA levels were significantly reduced in a dose-dependent manner in antisense oligonucleotide treated cells.

TABLE 15

| ISIS No | 0.75 µM | 1.50 µM | 3.00 µM | 6.00 µM | 12.00 µM | IC$_{50}$ (µM) | SEQ ID NO |
|---|---|---|---|---|---|---|---|
| 233717 | 23 | 45 | 13 | 33 | 40 | >12 | 14 |
| 544120 | 45 | 65 | 76 | 88 | 91 | 0.7 | 15 |
| 544145 | 38 | 42 | 61 | 82 | 84 | 1.6 | 16 |
| 544156 | 31 | 42 | 63 | 78 | 84 | 1.8 | 17 |
| 544162 | 35 | 43 | 71 | 76 | 82 | 1.6 | 18 |
| 544166 | 30 | 47 | 60 | 76 | 84 | 1.8 | 19 |
| 544199 | 54 | 61 | 73 | 83 | 84 | 0.5 | 20 |
| 544355 | 45 | 46 | 69 | 77 | 83 | 1.2 | 21 |
| 544368 | 12 | 37 | 63 | 74 | 81 | 2.6 | 22 |
| 544373 | 1 | 27 | 40 | 29 | 28 | >12 | 23 |
| 544376 | 26 | 53 | 61 | 63 | 59 | 2.4 | 24 |
| 544380 | 16 | 33 | 41 | 64 | 39 | 8.4 | 25 |
| 544383 | 14 | 33 | 46 | 61 | 63 | 4.4 | 26 |
| 544410 | 10 | 41 | 48 | 62 | 69 | 3.6 | 27 |

Example 3: Dose-Dependent Antisense Inhibition of Human ANGPTL3 in Hep3B Cells by MOE Gapmers 5-10-5 MOE gapmers from the studies described above exhibiting significant in vitro inhibition of ANGPTL3 mRNA were selected and tested at various doses in Hep3B cells. Cells were plated at a density of 20,000 cells per well and transfected using electroporation with 0.813 µM, 1.625 µM, 3.25 µM, 6.50 µM and 13.00 µM concentrations of antisense oligonucleotide, as specified in the Table below. After a treatment period of approximately 16 hours, RNA was isolated from the cells and ANGPTL3 mRNA levels were measured by quantitative real-time PCR. Human primer probe set RTS3492_MGB was used to measure mRNA levels. ANGPTL3 mRNA levels were adjusted according to total RNA content, as measured by RIBOGREEN®. Results are presented as percent inhibition of ANGPTL3, relative to untreated control cells.

The half maximal inhibitory concentration (IC$_{50}$) of each oligonucleotide is also presented. ANGPTL3 mRNA levels were significantly reduced in a dose-dependent manner in antisense oligonucleotide treated cells.

TABLE 16

| ISIS No | 0.813 µM | 1.625 µM | 3.25 µM | 6.50 µM | 13.00 µM | IC$_{50}$ (µM) | SEQ ID NO |
|---|---|---|---|---|---|---|---|
| 337487 | 17 | 37 | 58 | 72 | 92 | 2.7 | 28 |
| 337492 | 0 | 0 | 0 | 5 | 58 | >13 | 29 |
| 544120 | 23 | 40 | 65 | 81 | 91 | 2.2 | 15 |
| 560236 | 39 | 22 | 46 | 9 | 60 | >13 | 30 |
| 560265 | 38 | 48 | 58 | 64 | 73 | 2.0 | 31 |
| 560268 | 37 | 57 | 60 | 71 | 83 | 1.5 | 32 |
| 560285 | 5 | 29 | 48 | 68 | 78 | 3.8 | 33 |
| 560306 | 45 | 64 | 67 | 81 | 86 | 0.9 | 34 |
| 560400 | 48 | 63 | 75 | 87 | 88 | 0.7 | 35 |
| 560401 | 49 | 75 | 79 | 89 | 88 | 0.5 | 36 |
| 560402 | 42 | 67 | 70 | 85 | 90 | 0.9 | 37 |
| 560469 | 43 | 55 | 70 | 74 | 83 | 1.2 | 38 |
| 560470 | 31 | 54 | 64 | 73 | 81 | 1.8 | 39 |

TABLE 16-continued

| ISIS No | 0.813 µM | 1.625 µM | 3.25 µM | 6.50 µM | 13.00 µM | IC$_{50}$ (µM) | SEQ ID NO |
|---|---|---|---|---|---|---|---|
| 560471 | 26 | 43 | 59 | 62 | 77 | 2.7 | 40 |
| 560474 | 42 | 50 | 60 | 54 | 72 | 1.8 | 41 |

TABLE 17

| ISIS No | 0.813 µM | 1.625 µM | 3.25 µM | 6.50 µM | 13.00 µM | IC$_{50}$ (µM) | SEQ ID NO |
|---|---|---|---|---|---|---|---|
| 337487 | 20 | 35 | 51 | 78 | 89 | 1.8 | 28 |
| 544120 | 31 | 46 | 62 | 84 | 90 | 0.5 | 15 |
| 544145 | 4 | 36 | 60 | 58 | 89 | 3.8 | 16 |
| 544156 | 22 | 35 | 46 | 66 | 73 | 1.8 | 17 |
| 544162 | 2 | 21 | 54 | 69 | 87 | >13 | 18 |
| 544166 | 15 | 0 | 25 | 59 | 89 | >13 | 19 |
| 544199 | 61 | 37 | 57 | 53 | 81 | 0.9 | 20 |
| 544355 | 0 | 47 | 50 | 73 | 84 | >13 | 21 |
| 544376 | 4 | 14 | 38 | 66 | 88 | 0.9 | 24 |
| 560566 | 53 | 68 | 70 | 76 | 85 | >13 | 42 |
| 560567 | 55 | 70 | 75 | 78 | 89 | 2.7 | 43 |
| 560574 | 49 | 63 | 68 | 74 | 84 | 2.0 | 44 |
| 560596 | 28 | 40 | 41 | 52 | 75 | 1.5 | 45 |
| 560607 | 35 | 53 | 65 | 70 | 85 | 3.8 | 46 |
| 560608 | 40 | 50 | 62 | 68 | 83 | 0.9 | 47 |
| 560723 | 36 | 51 | 59 | 65 | 75 | 2.2 | 48 |
| 560735 | 36 | 44 | 59 | 72 | 85 | >13 | 49 |
| 560736 | 26 | 34 | 50 | 64 | 80 | 0.7 | 50 |
| 560744 | 28 | 49 | 59 | 75 | 83 | 0.9 | 51 |
| 560778 | 24 | 46 | 60 | 67 | 85 | 1.8 | 52 |
| 560789 | 14 | 23 | 36 | 49 | 71 | 2.7 | 53 |
| 560811 | 32 | 50 | 65 | 73 | 87 | 1.2 | 54 |
| 560856 | 0 | 20 | 17 | 32 | 69 | 3.8 | 55 |
| 560925 | 2 | 16 | 38 | 52 | 82 | 2.7 | 56 |
| 560936 | 0 | 0 | 24 | 41 | 65 | 0.5 | 57 |
| 560938 | 0 | 26 | 30 | 43 | 50 | 0.9 | 58 |
| 560942 | 0 | 0 | 12 | 36 | 74 | 1.8 | 59 |
| 560956 | 0 | 16 | 16 | 68 | 81 | 0.5 | 60 |

TABLE 18

| ISIS No | 0.813 µM | 1.625 µM | 3.25 µM | 6.50 µM | 13.00 µM | IC$_{50}$ (µM) | SEQ ID NO |
|---|---|---|---|---|---|---|---|
| 337487 | 20 | 35 | 51 | 78 | 89 | 2.7 | 28 |
| 544120 | 31 | 46 | 62 | 84 | 90 | 1.9 | 15 |
| 560566 | 53 | 68 | 70 | 76 | 85 | 0.5 | 42 |
| 560567 | 55 | 70 | 75 | 78 | 89 | 0.4 | 43 |
| 560574 | 49 | 63 | 68 | 74 | 84 | 0.7 | 44 |
| 560596 | 28 | 40 | 41 | 52 | 75 | 3.9 | 45 |
| 560607 | 35 | 53 | 65 | 70 | 85 | 1.6 | 46 |
| 560608 | 40 | 50 | 62 | 68 | 83 | 1.6 | 47 |
| 560723 | 36 | 51 | 59 | 65 | 75 | 1.9 | 48 |
| 560735 | 36 | 44 | 59 | 72 | 85 | 2.0 | 49 |
| 560736 | 26 | 34 | 50 | 64 | 80 | 3.2 | 50 |
| 560744 | 28 | 49 | 59 | 75 | 83 | 2.1 | 51 |
| 560778 | 24 | 46 | 60 | 67 | 85 | 2.4 | 52 |
| 560789 | 14 | 23 | 36 | 49 | 71 | 5.7 | 53 |
| 560811 | 32 | 50 | 65 | 73 | 87 | 1.8 | 54 |

TABLE 19

| ISIS No | 0.813 µM | 1.625 µM | 3.25 µM | 6.50 µM | 13.00 µM | IC$_{50}$ (µM) | SEQ ID NO |
|---|---|---|---|---|---|---|---|
| 337487 | 10 | 21 | 49 | 73 | 90 | 3.4 | 28 |
| 544120 | 19 | 38 | 62 | 77 | 88 | 2.5 | 15 |
| 560768 | 1 | 14 | 14 | 28 | 51 | >13 | 61 |
| 560777 | 13 | 35 | 37 | 56 | 80 | 4.2 | 62 |
| 560791 | 13 | 28 | 28 | 24 | 11 | >13 | 63 |
| 560794 | 8 | 31 | 42 | 57 | 76 | 4.4 | 64 |
| 560799 | 0 | 14 | 21 | 43 | 72 | 7.2 | 65 |

TABLE 19-continued

| ISIS No | 0.813 µM | 1.625 µM | 3.25 µM | 6.50 µM | 13.00 µM | IC$_{50}$ (µM) | SEQ ID NO |
|---|---|---|---|---|---|---|---|
| 560803 | 26 | 44 | 52 | 55 | 69 | 3.4 | 66 |
| 560815 | 16 | 26 | 26 | 52 | 60 | 7.6 | 67 |
| 560817 | 0 | 0 | 11 | 18 | 37 | >13 | 68 |
| 560847 | 37 | 52 | 56 | 68 | 87 | 1.8 | 69 |
| 560879 | 15 | 18 | 38 | 53 | 72 | 5.4 | 70 |
| 560880 | 0 | 8 | 21 | 38 | 71 | 8.0 | 71 |
| 560891 | 7 | 25 | 32 | 35 | 62 | 8.9 | 72 |
| 560895 | 11 | 10 | 0 | 5 | 48 | >13 | 73 |

TABLE 20

| ISIS No | 0.813 µM | 1.625 µM | 3.25 µM | 6.50 µM | 13.00 µM | IC$_{50}$ (µM) | SEQ ID NO |
|---|---|---|---|---|---|---|---|
| 337487 | 20 | 14 | 38 | 65 | 88 | 3.9 | 28 |
| 544120 | 22 | 34 | 51 | 71 | 86 | 2.9 | 15 |
| 544145 | 21 | 39 | 62 | 63 | 90 | 2.6 | 16 |
| 544156 | 31 | 41 | 55 | 72 | 78 | 2.4 | 17 |
| 544162 | 0 | 37 | 59 | 75 | 87 | 2.7 | 18 |
| 544166 | 8 | 43 | 45 | 55 | 75 | 4.0 | 19 |
| 544199 | 53 | 46 | 64 | 62 | 81 | 1.1 | 20 |
| 544355 | 0 | 0 | 52 | 72 | 84 | 2.9 | 21 |
| 544376 | 2 | 22 | 39 | 51 | 76 | 5.2 | 24 |
| 560856 | 10 | 29 | 36 | 41 | 69 | 6.4 | 55 |
| 560925 | 0 | 35 | 46 | 59 | 81 | 3.5 | 56 |
| 560936 | 18 | 9 | 35 | 55 | 69 | 5.9 | 57 |
| 560938 | 14 | 34 | 42 | 49 | 58 | 6.5 | 58 |
| 560942 | 8 | 13 | 27 | 47 | 77 | 6.1 | 59 |
| 560956 | 16 | 31 | 0 | 69 | 81 | 3.9 | 60 |

TABLE 21

| ISIS No | 0.813 µM | 1.625 µM | 3.25 µM | 6.50 µM | 13.00 µM | IC$_{50}$ (µM) | SEQ ID NO |
|---|---|---|---|---|---|---|---|
| 233717 | 11 | 0 | 33 | 58 | 75 | 5.0 | 14 |
| 337484 | 39 | 54 | 55 | 66 | 79 | 1.7 | 74 |
| 337487 | 35 | 42 | 67 | 82 | 92 | 1.8 | 28 |
| 544120 | 53 | 47 | 78 | 84 | 92 | <0.8 | 15 |
| 563523 | 12 | 44 | 59 | 63 | 79 | 3.0 | 75 |
| 563547 | 33 | 51 | 55 | 43 | 58 | 4.6 | 76 |
| 563580 | 61 | 73 | 71 | 82 | 91 | <0.8 | 77 |
| 563637 | 36 | 55 | 69 | 77 | 88 | 1.4 | 78 |
| 563639 | 56 | 71 | 79 | 88 | 93 | <0.8 | 79 |
| 563641 | 30 | 42 | 56 | 77 | 84 | 2.2 | 80 |
| 563669 | 28 | 61 | 66 | 79 | 85 | 1.6 | 81 |
| 563681 | 35 | 67 | 74 | 75 | 70 | 0.9 | 82 |
| 563682 | 41 | 45 | 68 | 76 | 85 | 1.5 | 83 |
| 567068 | 32 | 37 | 50 | 66 | 81 | 2.8 | 84 |
| 567069 | 23 | 28 | 48 | 56 | 62 | 5.0 | 85 |

TABLE 22

| ISIS No | 0.813 µM | 1.625 µM | 3.25 µM | 6.50 µM | 13.00 µM | IC$_{50}$ (µM) | SEQ ID NO |
|---|---|---|---|---|---|---|---|
| 233717 | 9 | 0 | 25 | 62 | 74 | 5.5 | 14 |
| 337487 | 22 | 40 | 71 | 84 | 92 | 2.1 | 28 |
| 337516 | 36 | 54 | 78 | 81 | 92 | 1.3 | 86 |
| 544120 | 25 | 50 | 72 | 86 | 92 | 1.8 | 15 |
| 567078 | 54 | 64 | 70 | 78 | 78 | <0.8 | 87 |
| 567115 | 55 | 65 | 72 | 80 | 81 | <0.8 | 88 |
| 567134 | 33 | 58 | 53 | 57 | 69 | 2.2 | 89 |
| 567233 | 54 | 74 | 83 | 87 | 91 | <0.8 | 90 |
| 567291 | 54 | 67 | 71 | 80 | 89 | <0.8 | 91 |
| 567310 | 36 | 61 | 73 | 80 | 89 | 1.2 | 92 |
| 567320 | 63 | 77 | 88 | 88 | 92 | <0.8 | 93 |
| 567321 | 55 | 75 | 89 | 89 | 93 | <0.8 | 94 |

TABLE 22-continued

| ISIS No | 0.813 µM | 1.625 µM | 3.25 µM | 6.50 µM | 13.00 µM | IC$_{50}$ (µM) | SEQ ID NO |
|---|---|---|---|---|---|---|---|
| 567330 | 31 | 68 | 76 | 85 | 93 | 1.2 | 95 |
| 567334 | 36 | 54 | 76 | 82 | 87 | 1.3 | 96 |
| 567335 | 31 | 49 | 72 | 80 | 92 | 1.7 | 97 |

TABLE 23

| ISIS No | 0.813 µM | 1.625 µM | 3.25 µM | 6.50 µM | 13.00 µM | IC$_{50}$ (µM) | SEQ ID NO |
|---|---|---|---|---|---|---|---|
| 233717 | 0 | 0 | 23 | 66 | 64 | 6.6 | 14 |
| 337487 | 13 | 44 | 60 | 74 | 85 | 2.6 | 28 |
| 544120 | 24 | 47 | 53 | 78 | 83 | 2.3 | 15 |
| 568034 | 35 | 54 | 51 | 59 | 46 | 4.2 | 98 |
| 568047 | 36 | 55 | 70 | 69 | 72 | 1.4 | 99 |
| 568048 | 41 | 64 | 63 | 66 | 66 | 0.9 | 100 |
| 568049 | 50 | 70 | 70 | 74 | 73 | <0.8 | 101 |
| 568056 | 33 | 56 | 68 | 63 | 64 | 1.7 | 102 |
| 568144 | 27 | 57 | 63 | 63 | 76 | 2.0 | 103 |
| 568146 | 50 | 61 | 61 | 63 | 77 | <0.8 | 104 |
| 568151 | 23 | 46 | 59 | 68 | 66 | 2.8 | 105 |
| 568206 | 24 | 40 | 56 | 61 | 75 | 3.0 | 106 |
| 568293 | 0 | 39 | 46 | 59 | 78 | 4.1 | 107 |
| 568300 | 22 | 36 | 61 | 68 | 73 | 3.0 | 108 |
| 568330 | 16 | 48 | 54 | 73 | 82 | 2.7 | 109 |

Example 4: Antisense Inhibition of Human ANGPTL3 in Hep3B Cells by Deoxy, MOE and (S)-cEt Gapmers Additional antisense oligonucleotides were designed targeting an ANGPTL3 nucleic acid and were tested for their effects on ANGPTL3 mRNA in vitro. Cultured Hep3B cells at a density of 20,000 cells per well were transfected using electroporation with 4,500 nM of antisense oligonucleotide. After a treatment period of approximately 24 hours, RNA was isolated from the cells and ANGPTL3 mRNA levels were measured by quantitative real-time PCR. Human primer probe set RTS3492_MGB was used to measure mRNA levels. ANGPTL3 mRNA levels were adjusted according to total RNA content, as measured by RIBOGREEN®. Results are presented as percent inhibition of ANGPTL3, relative to untreated control cells.

The newly designed chimeric antisense oligonucleotides in the Tables below were designed as deoxy, MOE, and (S)-cEt oligonucleotides. The deoxy, MOE and (S)-cEt oligonucleotides are 16 nucleosides in length wherein the nucleoside have either a MOE sugar modification, a (S)-cEt sugar modification, or a deoxy sugar residue. The sugar modifications of each antisense oligonucleotide is described as 'eek-d10-kke', where 'k' indicates a (S)-cEt sugar modification; 'd' indicates deoxyribose; the number indicates the number of deoxyribose sugars residues; and 'e' indicates a MOE sugar modification. The internucleoside linkages throughout each oligonucleotide are phosphorothioate (P=S) linkages. All cytosine residues throughout each oligonucleotide are 5-methylcytosines. "Start site" indicates the 5'-most nucleoside to which the oligonucleotide is targeted in the human gene sequence. "Stop site" indicates the 3'-most nucleoside to which the oligonucleotide is targeted human gene sequence. Each oligonucleotide listed in the Tables below is targeted to either the human ANGPTL3 mRNA, designated herein as SEQ ID NO: 1 (GENBANK Accession No. NM_014495.2) or the human ANGPTL3 genomic sequence, designated herein as SEQ ID NO: 2 (GENBANK Accession No. NT_032977.9 truncated from nucleotides 33032001 to 33046000). 'n/a' indicates that the antisense oligonucleotide does not target that particular gene sequence with 100% complementarity.

TABLE 24

Inhibition of ANGPTL3 mRNA by deoxy, MOE and cEt oligonucleotides targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 561681 | N/A | N/A | TCTGGAAGCAGACCTA | 37 | 3096 | 3111 | 3029 |
| 561682 | N/A | N/A | CTTCTGGAAGCAGACC | 27 | 3098 | 3113 | 3030 |
| 561683 | N/A | N/A | AAATAAGGTATAGTGA | 2 | 11084 | 11099 | 3031 |
| 561684 | N/A | N/A | TAGTATTAAGTGTTAA | 14 | 11133 | 11148 | 3032 |
| 561685 | N/A | N/A | TCATAGTATTAAGTGT | 0 | 11136 | 11151 | 3033 |
| 561686 | N/A | N/A | AGATTCCTTTACAATT | 21 | 11160 | 11175 | 3034 |
| 561687 | N/A | N/A | ACAAGATTCCTTTACA | 21 | 11163 | 11178 | 3035 |
| 561688 | N/A | N/A | CTGACAAGATTCCTTT | 70 | 11166 | 11181 | 3036 |
| 561689 | N/A | N/A | AATCTGACAAGATTCC | 83 | 11169 | 11184 | 180 |
| 561690 | N/A | N/A | TGTAATCTGACAAGAT | 46 | 11172 | 11187 | 3037 |
| 561691 | N/A | N/A | TACTGTAATCTGACAA | 47 | 11175 | 11190 | 3038 |
| 561692 | N/A | N/A | TCTTACTGTAATCTGA | 50 | 11178 | 11193 | 3039 |
| 561693 | N/A | N/A | CATTCTTACTGTAATC | 40 | 11181 | 11196 | 3040 |
| 561694 | N/A | N/A | GTTCATTCTTACTGTA | 71 | 11184 | 11199 | 3041 |
| 561695 | N/A | N/A | ATATGTTCATTCTTAC | 2 | 11188 | 11203 | 3042 |
| 561696 | N/A | N/A | GCCACAAATATGTTCA | 80 | 11195 | 11210 | 3043 |
| 561697 | N/A | N/A | GATGCCACAAATATGT | 70 | 11198 | 11213 | 3044 |
| 561698 | N/A | N/A | CTCGATGCCACAAATA | 80 | 11201 | 11216 | 181 |
| 561699 | N/A | N/A | TAACTCGATGCCACAA | 86 | 11204 | 11219 | 182 |
| 561700 | N/A | N/A | CTTTAACTCGATGCCA | 77 | 11207 | 11222 | 3045 |
| 561701 | N/A | N/A | AAACTTTAACTCGATG | 39 | 11210 | 11225 | 3046 |
| 561702 | N/A | N/A | TATAAACTTTAACTCG | 13 | 11213 | 11228 | 3047 |
| 561703 | N/A | N/A | CACAGCATATTTAGGG | 71 | 11233 | 11248 | 3048 |
| 561704 | N/A | N/A | TAGAATCACAGCATAT | 68 | 11239 | 11254 | 3049 |
| 561705 | N/A | N/A | TATTAGAATCACAGCA | 73 | 11242 | 11257 | 3050 |
| 561706 | N/A | N/A | AATGTATTAGAATCAC | 40 | 11246 | 11261 | 3051 |
| 561707 | N/A | N/A | ACGAATGTATTAGAAT | 22 | 11249 | 11264 | 3052 |
| 561708 | N/A | N/A | TACACGAATGTATTAG | 33 | 11252 | 11267 | 3053 |
| 561709 | N/A | N/A | ACCTACACGAATGTAT | 42 | 11255 | 11270 | 3054 |
| 561710 | N/A | N/A | AAACCTACACGAATG | 24 | 11258 | 11273 | 3055 |
| 561711 | N/A | N/A | TTGAAAACCTACACGA | 34 | 11261 | 11276 | 3056 |
| 561712 | N/A | N/A | TACTTGAAAACCTACA | 33 | 11264 | 11279 | 3057 |
| 561713 | N/A | N/A | GTTTATTTCTACTTGA | 53 | 11273 | 11288 | 3058 |
| 561714 | N/A | N/A | GAGGTTTATTTCTACT | 69 | 11276 | 11291 | 3059 |
| 561715 | N/A | N/A | TACGAGGTTTATTTCT | 21 | 11279 | 11294 | 3060 |
| 561716 | N/A | N/A | TGTTACGAGGTTTATT | 47 | 11282 | 11297 | 3061 |

TABLE 24-continued

Inhibition of ANGPTL3 mRNA by deoxy, MOE and cEt oligonucleotides targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 561717 | N/A | N/A | ACTTGTTACGAGGTTT | 70 | 11285 | 11300 | 3062 |
| 561718 | N/A | N/A | CAGTAACTTGTTACGA | 60 | 11290 | 11305 | 3063 |
| 561719 | N/A | N/A | GTTCAGTAACTTGTTA | 40 | 11293 | 11308 | 3064 |
| 561720 | N/A | N/A | TCAGGCTGTTTAAACG | 59 | 11308 | 11323 | 3065 |
| 561721 | N/A | N/A | TTGTCAGGCTGTTTAA | 74 | 11311 | 11326 | 3066 |
| 561722 | N/A | N/A | TGCTTGTCAGGCTGTT | 82 | 11314 | 11329 | 183 |
| 561723 | N/A | N/A | ACATGCTTGTCAGGCT | 84 | 11317 | 11332 | 184 |
| 561724 | N/A | N/A | TATACATGCTTGTCAG | 75 | 11320 | 11335 | 3067 |
| 561725 | N/A | N/A | GTCTTTGTTTATTGAA | 49 | 11347 | 11362 | 3068 |
| 561726 | N/A | N/A | TGGGTCTTTGTTTATT | 27 | 11350 | 11365 | 3069 |
| 561727 | N/A | N/A | GACTGGGTCTTTGTTT | 20 | 11353 | 11368 | 3070 |
| 561728 | N/A | N/A | ATAATTTAGGGACTGG | 20 | 11363 | 11378 | 3071 |
| 561729 | N/A | N/A | TCTATAATTTAGGGAC | 39 | 11366 | 11381 | 3072 |
| 561730 | N/A | N/A | CGATAAACATGCAAGA | 68 | 11394 | 11409 | 3073 |
| 561731 | N/A | N/A | TGTCGATAAACATGCA | 80 | 11397 | 11412 | 3074 |
| 561732 | N/A | N/A | TGATGTCGATAAACAT | 68 | 11400 | 11415 | 3075 |
| 561733 | N/A | N/A | TTGTGATGTCGATAAA | 28 | 11403 | 11418 | 3076 |
| 561734 | N/A | N/A | CTGTTGTGATGTCGAT | 74 | 11406 | 11421 | 3077 |
| 561735 | N/A | N/A | GATCTGTTGTGATGTC | 59 | 11409 | 11424 | 3078 |
| 561736 | N/A | N/A | AGGGATCTGTTGTGAT | 24 | 11412 | 11427 | 3079 |
| 561737 | N/A | N/A | TTTAGGGATCTGTTGT | 19 | 11415 | 11430 | 3080 |
| 561738 | N/A | N/A | GGATTTAGGGATCTGT | 27 | 11418 | 11433 | 3081 |
| 561739 | N/A | N/A | GATTTAGGGATTTAGG | 44 | 11425 | 11440 | 3082 |
| 561740 | N/A | N/A | TCTTTAGGGATTTAGG | 38 | 11433 | 11448 | 3083 |
| 561741 | N/A | N/A | TAATCTTTAGGGATTT | 0 | 11436 | 11451 | 3084 |
| 561742 | N/A | N/A | ATCTAATCTTTAGGGA | 0 | 11439 | 11454 | 3085 |
| 561743 | N/A | N/A | TGTATCTAATCTTTAG | 15 | 11442 | 11457 | 3086 |
| 561744 | N/A | N/A | AAATTTGTATCTAATC | 21 | 11447 | 11462 | 3087 |
| 561745 | N/A | N/A | GTAAAAATTTGTATC | 23 | 11452 | 11467 | 3088 |
| 561746 | N/A | N/A | GTGGTAAAAATTTGT | 32 | 11455 | 11470 | 3089 |
| 561747 | N/A | N/A | GATACTGTGGTAAAAA | 45 | 11461 | 11476 | 3090 |
| 561748 | N/A | N/A | AGTGATACTGTGGTAA | 60 | 11464 | 11479 | 3091 |
| 561749 | N/A | N/A | ACAAGTGATACTGTGG | 75 | 11467 | 11482 | 3092 |
| 561750 | N/A | N/A | CTGACAAGTGATACTG | 59 | 11470 | 11485 | 3093 |
| 561751 | N/A | N/A | ATTCTGACAAGTGATA | 48 | 11473 | 11488 | 3094 |

TABLE 24-continued

Inhibition of ANGPTL3 mRNA by deoxy, MOE and cEt oligonucleotides targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 561752 | N/A | N/A | TAAATTCTGACAAGTG | 59 | 11476 | 11491 | 3095 |
| 561753 | N/A | N/A | TACTGGCAGTTTTAAA | 42 | 11508 | 11523 | 3096 |
| 561754 | N/A | N/A | TCTTACTGGCAGTTTT | 51 | 11511 | 11526 | 3097 |
| 561755 | N/A | N/A | ATTTCTTACTGGCAGT | 69 | 11514 | 11529 | 3098 |
| 561756 | N/A | N/A | AAAATTCTTACTGGC | 57 | 11517 | 11532 | 3099 |
| 561757 | N/A | N/A | AACAAATGGGTTTAAT | 0 | 11535 | 11550 | 3100 |
| 562374 | N/A | N/A | GAATATTTGCAAGTCT | 68 | 9230 | 9245 | 3101 |
| 562375 | N/A | N/A | GTAGAGGAATATTTGC | 83 | 9236 | 9251 | 151 |
| 562376 | N/A | N/A | TCATTGGTAGAGGAAT | 23 | 9242 | 9257 | 3102 |
| 562377 | N/A | N/A | ATATTTTAAAGTCTCG | 17 | 9258 | 9273 | 3103 |
| 562378 | N/A | N/A | GTTACATTATTATAGA | 29 | 9273 | 9288 | 3104 |
| 562379 | N/A | N/A | GTGAAATGTGTTACAT | 54 | 9282 | 9297 | 3105 |
| 562380 | N/A | N/A | TCACCAGTGAAATGTG | 64 | 9288 | 9303 | 3106 |
| 562381 | N/A | N/A | CATGTTTCACCAGTGA | 78 | 9294 | 9309 | 3107 |
| 562382 | N/A | N/A | ACAAGACATGTTTCAC | 36 | 9300 | 9315 | 3108 |
| 562383 | N/A | N/A | CATATGACAAGACATG | 42 | 9306 | 9321 | 3109 |
| 562384 | N/A | N/A | CTATAATGCATATGAC | 5 | 9314 | 9329 | 3110 |
| 562385 | N/A | N/A | TCCTTTCTATAATGCA | 65 | 9320 | 9335 | 3111 |
| 562386 | N/A | N/A | TGATTATCCTTTCTAT | 27 | 9326 | 9341 | 3112 |
| 562387 | N/A | N/A | AAAGTCTGATTATCCT | 90 | 9332 | 9347 | 152 |
| 562388 | N/A | N/A | TAACTGAAAGTCTGAT | 59 | 9338 | 9353 | 3113 |
| 562389 | N/A | N/A | GTGCACAAAAATGTTA | 42 | 9366 | 9381 | 3114 |
| 562390 | N/A | N/A | AGCTATGTGCACAAAA | 77 | 9372 | 9387 | 3115 |
| 562391 | N/A | N/A | GAAGATAGCTATGTGC | 64 | 9378 | 9393 | 3116 |
| 562392 | N/A | N/A | TTTATTGAAGATAGCT | 33 | 9384 | 9399 | 3117 |
| 562393 | N/A | N/A | TCATTTTAGTGTATCT | 40 | 9424 | 9439 | 3118 |
| 562394 | N/A | N/A | CCTTGATCATTTTAGT | 15 | 9430 | 9445 | 3119 |
| 562395 | N/A | N/A | TGAATCCCTTGATCAT | 59 | 9436 | 9451 | 3120 |
| 562396 | N/A | N/A | TAGTCTTGAATCCCTT | 83 | 9442 | 9457 | 153 |
| 562397 | N/A | N/A | GTTGTTAGTCTTGAA | 65 | 9448 | 9463 | 3121 |
| 562398 | N/A | N/A | AATTGAGTTGTTTAGT | 21 | 9454 | 9469 | 3122 |
| 562399 | N/A | N/A | GCAACTAATTGAGTTG | 15 | 9460 | 9475 | 3123 |
| 562400 | N/A | N/A | ATTGGTGCAACTAATT | 25 | 9466 | 9481 | 3124 |
| 562401 | N/A | N/A | GTTTTTTATTGGTGCA | 53 | 9473 | 9488 | 3125 |
| 562402 | N/A | N/A | GGACACTGACAGTTTT | 43 | 9496 | 9511 | 3126 |
| 562403 | N/A | N/A | CAGGTTGGACACTGAC | 23 | 9502 | 9517 | 3127 |

TABLE 24-continued

Inhibition of ANGPTL3 mRNA by deoxy, MOE and cEt oligonucleotides targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 562404 | N/A | N/A | TAAGTACAGGTTGGAC | 33 | 9508 | 9523 | 3128 |
| 562405 | N/A | N/A | AGTTATTAAGTACAGG | 34 | 9514 | 9529 | 3129 |
| 562406 | N/A | N/A | TCTGTGAGTTATTAAG | 10 | 9520 | 9535 | 3130 |
| 562407 | N/A | N/A | ACCAAAATTCTCCTGA | 1 | 9554 | 9569 | 3131 |
| 562408 | N/A | N/A | ACCTGAATAACCCTCT | 73 | 9811 | 9826 | 3132 |
| 562409 | N/A | N/A | GGTATCAGAAAAGAT | 14 | 9827 | 9842 | 3133 |
| 562410 | N/A | N/A | AGTATTGGTATCAGAA | 13 | 9833 | 9848 | 3134 |
| 562411 | N/A | N/A | GGAAGATACTTTGAAG | 25 | 9861 | 9876 | 3135 |
| 562412 | N/A | N/A | AATGTGGGAAGATACT | 23 | 9867 | 9882 | 3136 |
| 562413 | N/A | N/A | CAGATAATAGCTAATA | 29 | 9882 | 9897 | 3137 |
| 562414 | N/A | N/A | TCATTGCAGATAATAG | 45 | 9888 | 9903 | 3138 |
| 562415 | N/A | N/A | AAGTTGTCATTGCAGA | 86 | 9894 | 9909 | 154 |
| 562416 | N/A | N/A | GATTCGGATTTTTAAA | 19 | 9909 | 9924 | 3139 |
| 562417 | N/A | N/A | ATTTGGGATTCGGATT | 34 | 9915 | 9930 | 3140 |
| 562418 | N/A | N/A | ACGCTTATTTGGGATT | 64 | 9921 | 9936 | 3141 |
| 562419 | N/A | N/A | TCTAGAGAGAAAACGC | 64 | 9933 | 9948 | 3142 |
| 562420 | N/A | N/A | AGTTAAGAGGTTTTCG | 34 | 9949 | 9964 | 3143 |
| 562421 | N/A | N/A | CATTATAGTTAAGAGG | 24 | 9955 | 9970 | 3144 |
| 562422 | N/A | N/A | CACTTTCATTATAGTT | 13 | 9961 | 9976 | 3145 |
| 562423 | N/A | N/A | TAGAATGAACACTTTC | 63 | 9970 | 9985 | 3146 |
| 562424 | N/A | N/A | TTGAACTAGAATGAAC | 16 | 9976 | 9991 | 3147 |
| 562425 | N/A | N/A | ACCTGATTGAACTAGA | 51 | 9982 | 9997 | 3148 |
| 562426 | N/A | N/A | TAAAATACCTGATTGA | 19 | 9988 | 10003 | 3149 |
| 562427 | N/A | N/A | TAGAGGTAAAATACCT | 12 | 9994 | 10009 | 3150 |
| 562428 | N/A | N/A | GAAGATTAGAGGTAAA | 1 | 10000 | 10015 | 3151 |
| 562429 | N/A | N/A | TCTGAGGAAGATTAGA | 31 | 10006 | 10021 | 3152 |
| 562430 | N/A | N/A | TATACACTACCAAAAA | 0 | 10030 | 10045 | 3153 |
| 562431 | N/A | N/A | ATAATCTATACACTAC | 0 | 10036 | 10051 | 3154 |
| 562432 | N/A | N/A | TAAGTCCCAATTTTAA | 33 | 10065 | 10080 | 3155 |
| 562433 | N/A | N/A | TCTGTATAAGTCCCAA | 89 | 10071 | 10086 | 155 |
| 562434 | N/A | N/A | CCAGTTTTAAATAATC | 20 | 10085 | 10100 | 3156 |
| 562435 | N/A | N/A | TGTATCCCAGTTTTAA | 44 | 10091 | 10106 | 3157 |
| 562436 | N/A | N/A | GATGCATGTATCCCAG | 91 | 10097 | 10112 | 156 |
| 562437 | N/A | N/A | GTTTTAGATGCATGTA | 69 | 10103 | 10118 | 3158 |
| 562438 | N/A | N/A | TACAGTGTTTTAGATG | 28 | 10109 | 10124 | 3159 |

TABLE 24-continued

Inhibition of ANGPTL3 mRNA by deoxy, MOE and cEt oligonucleotides targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 562439 | N/A | N/A | GTAAGTTTATCTTCCT | 78 | 10138 | 10153 | 157 |
| 562440 | N/A | N/A | TTCCCCGTAAGTTTAT | 33 | 10144 | 10159 | 3160 |
| 562441 | N/A | N/A | CTGTATTTCCCCGTAA | 55 | 10150 | 10165 | 3161 |
| 562442 | N/A | N/A | CTGTTACTGTATTTCC | 79 | 10156 | 10171 | 158 |
| 562443 | N/A | N/A | TAGTTACTGTTACTGT | 70 | 10162 | 10177 | 3162 |
| 562444 | N/A | N/A | CGTATGTAGTTACTGT | 66 | 10168 | 10183 | 3163 |
| 562445 | N/A | N/A | AATGGGTACAGACTCG | 72 | 10182 | 10197 | 3164 |
| 562446 | N/A | N/A | GCAATTTAATGGGTAC | 59 | 10189 | 10204 | 3165 |
| 562447 | N/A | N/A | GATAGATATGCAATTT | 20 | 10198 | 10213 | 3166 |
| 562448 | N/A | N/A | AAAGGAGATAGATATG | 22 | 10204 | 10219 | 3167 |
| 562449 | N/A | N/A | CCTCCTAAAGGAGATA | 42 | 10210 | 10225 | 3168 |
| 562450 | N/A | N/A | CACCAGCCTCCTAAAG | 37 | 10216 | 10231 | 3169 |
| 560990 | 709 | 724 | TTCTTGGTGCTCTTGG | 89 | 6722 | 6737 | 111 |
| 561373 | 1197 | 1212 | TTTGTGATCCCAAGTA | 40 | 9772 | 9787 | 3170 |
| 561374 | 1199 | 1214 | GCTTTGTGATCCCAAG | 76 | 9774 | 9789 | 3171 |
| 561375 | 1201 | 1216 | TTGCTTTGTGATCCCA | 82 | 9776 | 9791 | 3172 |
| 561376 | 1203 | 1218 | TTTTGCTTTGTGATCC | 40 | 9778 | 9793 | 3173 |
| 561377 | 1205 | 1220 | CCTTTTGCTTTGTGAT | 38 | 9780 | 9795 | 3174 |
| 561378 | 1207 | 1222 | GTCCTTTTGCTTTGTG | 75 | 9782 | 9797 | 3175 |
| 561379 | 1209 | 1224 | GTGTCCTTTTGCTTTG | 40 | 9784 | 9799 | 3176 |
| 561527 | 1604 | 1619 | GAAATGTAAACGGTAT | 47 | 10576 | 10591 | 3177 |
| 561528 | 1606 | 1621 | GAGAAATGTAAACGGT | 89 | 10578 | 10593 | 174 |
| 561529 | 1608 | 1623 | TTGAGAAATGTAAACG | 55 | 10580 | 10595 | 3178 |
| 561530 | 1611 | 1626 | TGATTGAGAAATGTAA | 18 | 10583 | 10598 | 3179 |
| 561531 | 1613 | 1628 | TTTGATTGAGAAATGT | 30 | 10585 | 10600 | 3180 |
| 561532 | 1619 | 1634 | AAGAATTTTGATTGAG | 53 | 10591 | 10606 | 3181 |
| 561533 | 1621 | 1636 | ATAAGAATTTTGATTG | 29 | 10593 | 10608 | 3182 |
| 561534 | 1632 | 1647 | CAAATAGTATTATAAG | 6 | 10604 | 10619 | 3183 |
| 561535 | 1653 | 1668 | CCCACATCACAAAATT | 70 | 10625 | 10640 | 3184 |
| 561536 | 1657 | 1672 | GATTCCCACATCACAA | 77 | 10629 | 10644 | 3185 |
| 561537 | 1659 | 1674 | TTGATTCCCACATCAC | 78 | 10631 | 10646 | 3186 |
| 561538 | 1661 | 1676 | AATTGATTCCCACATC | 68 | 10633 | 10648 | 3187 |
| 561539 | 1663 | 1678 | AAAATTGATTCCCACA | 72 | 10635 | 10650 | 3188 |
| 561540 | 1665 | 1680 | CTAAAATTGATTCCCA | 54 | 10637 | 10652 | 3189 |
| 561541 | 1668 | 1683 | CATCTAAAATTGATTC | 0 | 10640 | 10655 | 3190 |
| 561542 | 1670 | 1685 | ACCATCTAAAATTGAT | 35 | 10642 | 10657 | 3191 |

TABLE 24-continued

Inhibition of ANGPTL3 mRNA by deoxy, MOE and cEt oligonucleotides targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 561543 | 1672 | 1687 | TGACCATCTAAAATTG | 55 | 10644 | 10659 | 3192 |
| 561544 | 1674 | 1689 | TGTGACCATCTAAAAT | 56 | 10646 | 10661 | 3193 |
| 561545 | 1676 | 1691 | ATTGTGACCATCTAAA | 73 | 10648 | 10663 | 3194 |
| 561546 | 1678 | 1693 | AGATTGTGACCATCTA | 67 | 10650 | 10665 | 3195 |
| 561547 | 1680 | 1695 | CTAGATTGTGACCATC | 50 | 10652 | 10667 | 3196 |
| 561548 | 1682 | 1697 | ATCTAGATTGTGACCA | 77 | 10654 | 10669 | 3197 |
| 561549 | 1684 | 1699 | TAATCTAGATTGTGAC | 55 | 10656 | 10671 | 3198 |
| 561550 | 1686 | 1701 | TATAATCTAGATTGTG | 28 | 10658 | 10673 | 3199 |
| 561551 | 1688 | 1703 | ATTATAATCTAGATTG | 52 | 10660 | 10675 | 3200 |
| 561552 | 1690 | 1705 | TGATTATAATCTAGAT | 43 | 10662 | 10677 | 3201 |
| 561553 | 1692 | 1707 | ATTGATTATAATCTAG | 53 | 10664 | 10679 | 3202 |
| 561554 | 1694 | 1709 | CTATTGATTATAATCT | 54 | 10666 | 10681 | 3203 |
| 561555 | 1696 | 1711 | ACCTATTGATTATAAT | 44 | 10668 | 10683 | 3204 |
| 561556 | 1698 | 1713 | TCACCTATTGATTATA | 52 | 10670 | 10685 | 3205 |
| 561557 | 1700 | 1715 | GTTCACCTATTGATTA | 50 | 10672 | 10687 | 3206 |
| 561558 | 1702 | 1717 | AAGTTCACCTATTGAT | 58 | 10674 | 10689 | 3207 |
| 561559 | 1704 | 1719 | ATAAGTTCACCTATTG | 66 | 10676 | 10691 | 3208 |
| 561560 | 1706 | 1721 | TAATAAGTTCACCTAT | 38 | 10678 | 10693 | 3209 |
| 561561 | 1708 | 1723 | TTTAATAAGTTCACCT | 50 | 10680 | 10695 | 3210 |
| 561562 | 1710 | 1725 | TATTTAATAAGTTCAC | 32 | 10682 | 10697 | 3211 |
| 561563 | 1712 | 1727 | GTTATTTAATAAGTTC | 47 | 10684 | 10699 | 3212 |
| 561564 | 1761 | 1776 | CATATGATGCCTTTTA | 63 | 10733 | 10748 | 3213 |
| 561565 | 1763 | 1778 | CTCATATGATGCCTTT | 81 | 10735 | 10750 | 175 |
| 561566 | 1765 | 1780 | AGCTCATATGATGCCT | 81 | 10737 | 10752 | 176 |
| 561567 | 1767 | 1782 | TTAGCTCATATGATGC | 84 | 10739 | 10754 | 177 |
| 561568 | 1769 | 1784 | TATTAGCTCATATGAT | 46 | 10741 | 10756 | 3214 |
| 561569 | 1771 | 1786 | GATATTAGCTCATATG | 49 | 10743 | 10758 | 3215 |
| 561570 | 1773 | 1788 | GTGATATTAGCTCATA | 81 | 10745 | 10760 | 3216 |
| 561571 | 1775 | 1790 | TTGTGATATTAGCTCA | 85 | 10747 | 10762 | 178 |
| 561572 | 1777 | 1792 | AGTTGTGATATTAGCT | 68 | 10749 | 10764 | 3217 |
| 561573 | 1779 | 1794 | AAAGTTGTGATATTAG | 45 | 10751 | 10766 | 3218 |
| 561574 | 1781 | 1796 | GGAAAGTTGTGATATT | 27 | 10753 | 10768 | 3219 |
| 561575 | 1783 | 1798 | TGGGAAAGTTGTGATA | 36 | 10755 | 10770 | 3220 |
| 561576 | 1785 | 1800 | ACTGGGAAAGTTGTGA | 83 | 10757 | 10772 | 179 |
| 561577 | 1787 | 1802 | AAACTGGGAAAGTTGT | 56 | 10759 | 10774 | 3221 |

TABLE 24-continued

Inhibition of ANGPTL3 mRNA by deoxy, MOE and cEt oligonucleotides targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 561578 | 1789 | 1804 | TTAAACTGGGAAAGTT | 44 | 10761 | 10776 | 3222 |
| 561579 | 1794 | 1809 | GTTTTTTAAACTGGGA | 58 | 10766 | 10781 | 3223 |
| 561580 | 1796 | 1811 | TAGTTTTTTAAACTGG | 0 | 10768 | 10783 | 3224 |
| 561581 | 1802 | 1817 | GAGTACTAGTTTTTA | 18 | 10774 | 10789 | 3225 |
| 561582 | 1804 | 1819 | AAGAGTACTAGTTTTT | 55 | 10776 | 10791 | 3226 |
| 561583 | 1806 | 1821 | ACAAGAGTACTAGTTT | 51 | 10778 | 10793 | 3227 |
| 561584 | 1808 | 1823 | TAACAAGAGTACTAGT | 53 | 10780 | 10795 | 3228 |
| 561585 | 1810 | 1825 | TTTAACAAGAGTACTA | 48 | 10782 | 10797 | 3229 |
| 561586 | 1812 | 1827 | GTTTTAACAAGAGTAC | 49 | 10784 | 10799 | 3230 |
| 561587 | 1814 | 1829 | GAGTTTTAACAAGAGT | 54 | 10786 | 10801 | 3231 |
| 561588 | 1816 | 1831 | TAGAGTTTTAACAAGA | 9 | 10788 | 10803 | 3232 |
| 561589 | 1819 | 1834 | GTTTAGAGTTTTAACA | 24 | 10791 | 10806 | 3233 |
| 561590 | 1822 | 1837 | CAAGTTTAGAGTTTTA | 30 | 10794 | 10809 | 3234 |
| 561591 | 1824 | 1839 | GTCAAGTTTAGAGTTT | 60 | 10796 | 10811 | 3235 |
| 561592 | 1826 | 1841 | TAGTCAAGTTTAGAGT | 56 | 10798 | 10813 | 3236 |
| 561593 | 1828 | 1843 | TTTAGTCAAGTTTAGA | 41 | 10800 | 10815 | 3237 |
| 561594 | 1830 | 1845 | TATTTAGTCAAGTTTA | 14 | 10802 | 10817 | 3238 |
| 561595 | 1832 | 1847 | TGTATTTAGTCAAGTT | 39 | 10804 | 10819 | 3239 |
| 561596 | 1834 | 1849 | TCTGTATTTAGTCAAG | 51 | 10806 | 10821 | 3240 |
| 561597 | 1836 | 1851 | CCTCTGTATTTAGTCA | 72 | 10808 | 10823 | 3241 |
| 561598 | 1838 | 1853 | GTCCTCTGTATTTAGT | 55 | 10810 | 10825 | 3242 |
| 561599 | 1840 | 1855 | CAGTCCTCTGTATTTA | 63 | 10812 | 10827 | 3243 |
| 561600 | 1842 | 1857 | ACCAGTCCTCTGTATT | 66 | 10814 | 10829 | 3244 |
| 561601 | 1844 | 1859 | TTACCAGTCCTCTGTA | 57 | 10816 | 10831 | 3245 |
| 561602 | 1846 | 1861 | AATTACCAGTCCTCTG | 43 | 10818 | 10833 | 3246 |
| 561603 | 1848 | 1863 | ACAATTACCAGTCCTC | 67 | 10820 | 10835 | 3247 |

TABLE 25

Inhibition of ANGPTL3 mRNA by deoxy, MOE and (S)-cEt gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 561770 | N/A | N/A | ACAAAGGTAGGTCACC | 77 | 11576 | 11591 | 143 |
| 586719 | N/A | N/A | TCTGACAAGATTCCTT | 76 | 11167 | 11182 | 3248 |
| 586720 | N/A | N/A | ATCTGACAAGATTCCT | 79 | 11168 | 11183 | 3249 |

TABLE 25-continued

Inhibition of ANGPTL3 mRNA by deoxy, MOE and (S)-cEt gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 586721 | N/A | N/A | TAATCTGACAAGATTC | 50 | 11170 | 11185 | 3250 |
| 586722 | N/A | N/A | GTAATCTGACAAGATT | 41 | 11171 | 11186 | 3251 |
| 586723 | N/A | N/A | CTTGTCAGGCTGTTTA | 50 | 11312 | 11327 | 3252 |
| 586724 | N/A | N/A | GCTTGTCAGGCTGTTT | 81 | 11313 | 11328 | 3253 |
| 586725 | N/A | N/A | ATGCTTGTCAGGCTGT | 78 | 11315 | 11330 | 3254 |
| 586726 | N/A | N/A | TACATGCTTGTCAGGC | 78 | 11318 | 11333 | 3255 |
| 586727 | N/A | N/A | ATACATGCTTGTCAGG | 76 | 11319 | 11334 | 3256 |
| 586728 | N/A | N/A | AAAGGTAGGTCACCAT | 72 | 11574 | 11589 | 3257 |
| 586729 | N/A | N/A | CAAAGGTAGGTCACCA | 69 | 11575 | 11590 | 3258 |
| 586730 | N/A | N/A | GACAAAGGTAGGTCAC | 55 | 11577 | 11592 | 3259 |
| 586731 | N/A | N/A | TGACAAAGGTAGGTCA | 32 | 11578 | 11593 | 3260 |
| 586732 | N/A | N/A | TCTGACATAGCTTTTT | 63 | 5436 | 5451 | 3261 |
| 586733 | N/A | N/A | ATTCTGACATAGCTTT | 76 | 5438 | 5453 | 3262 |
| 586734 | N/A | N/A | GATTCTGACATAGCTT | 73 | 5439 | 5454 | 3263 |
| 586735 | N/A | N/A | GGATTCTGACATAGCT | 81 | 5440 | 5455 | 3264 |
| 586736 | N/A | N/A | ATGGATTCTGACATAG | 74 | 5442 | 5457 | 3265 |
| 586737 | N/A | N/A | CATGGATTCTGACATA | 72 | 5443 | 5458 | 3266 |
| 586738 | N/A | N/A | ACATGGATTCTGACAT | 59 | 5444 | 5459 | 3267 |
| 586739 | N/A | N/A | TACATGGATTCTGACA | 71 | 5445 | 5460 | 3268 |
| 586740 | N/A | N/A | ATACATGGATTCTGAC | 60 | 5446 | 5461 | 3269 |
| 586741 | N/A | N/A | TTTAGCAGCACTACTA | 65 | 5628 | 5643 | 3270 |
| 586742 | N/A | N/A | TTTTAGCAGCACTACT | 51 | 5629 | 5644 | 3271 |
| 586743 | N/A | N/A | CTTTTAGCAGCACTAC | 74 | 5630 | 5645 | 3272 |
| 586744 | N/A | N/A | CCTTTTAGCAGCACTA | 83 | 5631 | 5646 | 223 |
| 586745 | N/A | N/A | ACCTTTTAGCAGCACT | 84 | 5632 | 5647 | 224 |
| 586746 | N/A | N/A | AAACCTTTTAGCAGCA | 87 | 5634 | 5649 | 225 |
| 586747 | N/A | N/A | AAAACCTTTTAGCAGC | 80 | 5635 | 5650 | 3273 |
| 586748 | N/A | N/A | GATAAAAACCTTTTA | 16 | 5640 | 5655 | 3274 |
| 586749 | N/A | N/A | TGATAAAAACCTTTT | 25 | 5641 | 5656 | 3275 |
| 586750 | N/A | N/A | AGATGTTGGCAGGTTG | 72 | 6188 | 6203 | 3276 |
| 586751 | N/A | N/A | TAGATGTTGGCAGGTT | 76 | 6189 | 6204 | 3277 |
| 586752 | N/A | N/A | GTAGATGTTGGCAGGT | 73 | 6190 | 6205 | 3278 |
| 586753 | N/A | N/A | TGTAGATGTTGGCAGG | 65 | 6191 | 6206 | 3279 |
| 586754 | N/A | N/A | CTGTAGATGTTGGCAG | 61 | 6192 | 6207 | 3280 |
| 586755 | N/A | N/A | ATCTGTAGATGTTGGC | 84 | 6194 | 6209 | 226 |

TABLE 25-continued

Inhibition of ANGPTL3 mRNA by deoxy, MOE and (S)-cEt gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 586756 | N/A | N/A | TATCTGTAGATGTTGG | 71 | 6195 | 6210 | 3281 |
| 586757 | N/A | N/A | ATATCTGTAGATGTTG | 61 | 6196 | 6211 | 3282 |
| 586758 | N/A | N/A | CATATCTGTAGATGTT | 63 | 6197 | 6212 | 3283 |
| 586759 | N/A | N/A | TTTGAACCAGGCTTTC | 47 | 6243 | 6258 | 3284 |
| 586760 | N/A | N/A | AATTTGAACCAGGCTT | 78 | 6245 | 6260 | 3285 |
| 586761 | N/A | N/A | TAATTTGAACCAGGCT | 83 | 6246 | 6261 | 227 |
| 586762 | N/A | N/A | CATAATTTGAACCAGG | 81 | 6248 | 6263 | 3286 |
| 586763 | N/A | N/A | ACATAATTTGAACCAG | 36 | 6249 | 6264 | 3287 |
| 586764 | N/A | N/A | TACATAATTTGAACCA | 38 | 6250 | 6265 | 3288 |
| 586765 | N/A | N/A | ATACATAATTTGAACC | 15 | 6251 | 6266 | 3289 |
| 586766 | N/A | N/A | ACATTGGTCGGAAAAC | 43 | 6424 | 6439 | 3290 |
| 586767 | N/A | N/A | GACATTGGTCGGAAAA | 49 | 6425 | 6440 | 3291 |
| 586768 | N/A | N/A | AGACATTGGTCGGAAA | 59 | 6426 | 6441 | 3292 |
| 586769 | N/A | N/A | CAGACATTGGTCGGAA | 66 | 6427 | 6442 | 3293 |
| 586770 | N/A | N/A | GCAGACATTGGTCGGA | 80 | 6428 | 6443 | 3294 |
| 586771 | N/A | N/A | AAGCAGACATTGGTCG | 65 | 6430 | 6445 | 3295 |
| 586772 | N/A | N/A | TGTACAGATTACCTGT | 51 | 6506 | 6521 | 3296 |
| 586773 | N/A | N/A | TTGTACAGATTACCTG | 34 | 6507 | 6522 | 3297 |
| 586774 | N/A | N/A | ATTGTACAGATTACCT | 62 | 6508 | 6523 | 3298 |
| 586775 | N/A | N/A | GATTGTACAGATTACC | 59 | 6509 | 6524 | 3299 |
| 586776 | N/A | N/A | AGATTGTACAGATTAC | 46 | 6510 | 6525 | 3300 |
| 586777 | N/A | N/A | TCAGATTGTACAGATT | 63 | 6512 | 6527 | 3301 |
| 586778 | N/A | N/A | TTCAGATTGTACAGAT | 63 | 6513 | 6528 | 3302 |
| 586779 | N/A | N/A | ATTCAGATTGTACAGA | 71 | 6514 | 6529 | 3303 |
| 586780 | N/A | N/A | TATTCAGATTGTACAG | 55 | 6515 | 6530 | 3304 |
| 586781 | N/A | N/A | TTATTCAGATTGTACA | 52 | 6516 | 6531 | 3305 |
| 586782 | N/A | N/A | TAGGTATGTCTTTTAT | 52 | 6936 | 6951 | 3306 |
| 586783 | N/A | N/A | TGTCTTAGGTATGTCT | 76 | 6941 | 6956 | 3307 |
| 586784 | N/A | N/A | ATTGTCTTAGGTATGT | 73 | 6943 | 6958 | 3308 |
| 586785 | N/A | N/A | GATTGTCTTAGGTATG | 60 | 6944 | 6959 | 3309 |
| 586786 | N/A | N/A | TTCTTAGATGGCGTGT | 74 | 7207 | 7222 | 3310 |
| 586787 | N/A | N/A | TTTTCTTAGATGGCGT | 86 | 7209 | 7224 | 228 |
| 586788 | N/A | N/A | ATTTTTCTTAGATGGC | 75 | 7211 | 7226 | 3311 |
| 586789 | N/A | N/A | CATTTTTCTTAGATGG | 49 | 7212 | 7227 | 3312 |
| 586790 | N/A | N/A | GCATTTTTCTTAGATG | 47 | 7213 | 7228 | 3313 |
| 586791 | N/A | N/A | ATAAGTCCCAATTTTA | 27 | 10066 | 10081 | 3314 |

TABLE 25-continued

Inhibition of ANGPTL3 mRNA by deoxy, MOE and (S)-cEt gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 586792 | N/A | N/A | TATAAGTCCCAATTTT | 27 | 10067 | 10082 | 3315 |
| 586793 | N/A | N/A | GTATAAGTCCCAATTT | 28 | 10068 | 10083 | 3316 |
| 586794 | N/A | N/A | TGTATAAGTCCCAATT | 38 | 10069 | 10084 | 3317 |
| 586795 | N/A | N/A | CTGTATAAGTCCCAAT | 69 | 10070 | 10085 | 3318 |
| 586796 | N/A | N/A | ATCTGTATAAGTCCCA | 88 | 10072 | 10087 | 229 |
| 586797 | N/A | N/A | AATCTGTATAAGTCCC | 84 | 10073 | 10088 | 230 |
| 586798 | N/A | N/A | TAATCTGTATAAGTCC | 58 | 10074 | 10089 | 3319 |
| 586799 | N/A | N/A | ATAATCTGTATAAGTC | 21 | 10075 | 10090 | 3320 |
| 586800 | N/A | N/A | AATAATCTGTATAAGT | 12 | 10076 | 10091 | 3321 |
| 586801 | N/A | N/A | TGCATGTATCCCAGTT | 80 | 10095 | 10110 | 3322 |
| 586802 | N/A | N/A | ATGCATGTATCCCAGT | 83 | 10096 | 10111 | 231 |
| 586803 | N/A | N/A | AGATGCATGTATCCCA | 79 | 10098 | 10113 | 232 |
| 586804 | N/A | N/A | TAGATGCATGTATCCC | 87 | 10099 | 10114 | 3323 |
| 586805 | N/A | N/A | TTAGATGCATGTATCC | 78 | 10100 | 10115 | 3324 |
| 586806 | N/A | N/A | TTTAGATGCATGTATC | 50 | 10101 | 10116 | 3325 |
| 586653 | 7 | 22 | GTGGAACTGTTTTCTT | 63 | 3111 | 3126 | 3326 |
| 586656 | 9 | 24 | ACGTGGAACTGTTTTC | 72 | 3113 | 3128 | 3327 |
| 586658 | 99 | 114 | TTGATCAATTCTGGAG | 74 | 3203 | 3218 | 3328 |
| 586660 | 101 | 116 | TCTTGATCAATTCTGG | 71 | 3205 | 3220 | 3329 |
| 561011 | 102 | 117 | GTCTTGATCAATTCTG | 91 | 3206 | 3221 | 114 |
| 586661 | 103 | 118 | TGTCTTGATCAATTCT | 85 | 3207 | 3222 | 209 |
| 586663 | 134 | 149 | GGCTCTGGAGATAGAG | 63 | 3238 | 3253 | 3330 |
| 586665 | 136 | 151 | TTGGCTCTGGAGATAG | 63 | 3240 | 3255 | 3331 |
| 586668 | 140 | 155 | GATTTTGGCTCTGGAG | 64 | 3244 | 3259 | 3332 |
| 586669 | 142 | 157 | TTGATTTTGGCTCTGG | 89 | 3246 | 3261 | 210 |
| 561026 | 143 | 158 | CTTGATTTTGGCTCTG | 84 | 3247 | 3262 | 117 |
| 586670 | 144 | 159 | TCTTGATTTTGGCTCT | 71 | 3248 | 3263 | 3333 |
| 586671 | 146 | 161 | AATCTTGATTTTGGCT | 70 | 3250 | 3265 | 3334 |
| 586672 | 148 | 163 | CAAATCTTGATTTTGG | 81 | 3252 | 3267 | 3335 |
| 586673 | 298 | 313 | GCAGCGATAGATCATA | 76 | 3402 | 3417 | 3336 |
| 586674 | 300 | 315 | TTGCAGCGATAGATCA | 76 | 3404 | 3419 | 3337 |
| 586675 | 304 | 319 | TGGTTTGCAGCGATAG | 82 | 3408 | 3423 | 3338 |
| 586676 | 306 | 321 | ACTGGTTTGCAGCGAT | 89 | 3410 | 3425 | 211 |
| 586677 | 315 | 330 | TTTGATTTCACTGGTT | 62 | 3419 | 3434 | 3339 |
| 586678 | 317 | 332 | TCTTTGATTTCACTGG | 66 | 3421 | 3436 | 3340 |

TABLE 25-continued

Inhibition of ANGPTL3 mRNA by deoxy, MOE and (S)-cEt gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 586679 | 342 | 357 | AGTTCTTCTCAGTTCC | 77 | 3446 | 3461 | 3341 |
| 586680 | 476 | 491 | TTAGTTAGTTGCTCTT | 65 | 3580 | 3595 | 3342 |
| 586681 | 478 | 493 | AGTTAGTTAGTTGCTC | 69 | 3582 | 3597 | 3343 |
| 586682 | 703 | 718 | GTGCTCTTGGCTTGGA | 78 | 6716 | 6731 | 3344 |
| 586683 | 705 | 720 | TGGTGCTCTTGGCTTG | 77 | 6718 | 6733 | 3345 |
| 586684 | 802 | 817 | TATGTTCACCTCTGTT | 55 | 7387 | 7402 | 3346 |
| 586685 | 804 | 819 | TGTATGTTCACCTCTG | 79 | 7389 | 7404 | 3347 |
| 586686 | 1260 | 1275 | ACACTCATCATGCCAC | 72 | 10232 | 10247 | 3348 |
| 586687 | 1262 | 1277 | CCACACTCATCATGCC | 82 | 10234 | 10249 | 3349 |
| 586688 | 1308 | 1323 | AGATTTGCTCTTGGT | 87 | 10280 | 10295 | 212 |
| 586689 | 1310 | 1325 | TTAGATTTTGCTCTTG | 78 | 10282 | 10297 | 3350 |
| 586690 | 1351 | 1366 | CATTTTGAGACTTCCA | 91 | 10323 | 10338 | 213 |
| 586691 | 1353 | 1368 | TCCATTTTGAGACTTC | 86 | 10325 | 10340 | 214 |
| 586692 | 1365 | 1380 | AGAGTATAACCTTCCA | 88 | 10337 | 10352 | 220 |
| 586693 | 1367 | 1382 | ATAGAGTATAACCTTC | 69 | 10339 | 10354 | 3351 |
| 586694 | 1402 | 1417 | AATCTGTTGGATGGAT | 59 | 10374 | 10389 | 3352 |
| 586695 | 1404 | 1419 | TGAATCTGTTGGATGG | 79 | 10376 | 10391 | 3353 |
| 586696 | 1420 | 1435 | TTCATTCAAAGCTTTC | 82 | 10392 | 10407 | 3354 |
| 586697 | 1422 | 1437 | AGTTCATTCAAAGCTT | 73 | 10394 | 10409 | 3355 |
| 561463 | 1423 | 1438 | CAGTTCATTCAAAGCT | 88 | 10395 | 10410 | 127 |
| 586698 | 1424 | 1439 | TCAGTTCATTCAAAGC | 69 | 10396 | 10411 | 3356 |
| 586699 | 1488 | 1503 | GATTATTAGACCACAT | 63 | 10460 | 10475 | 3357 |
| 586700 | 1490 | 1505 | CAGATTATTAGACCAC | 90 | 10462 | 10477 | 221 |
| 561487 | 1491 | 1506 | CCAGATTATTAGACCA | 95 | 10463 | 10478 | 131 |
| 586701 | 1492 | 1507 | ACCAGATTATTAGACC | 85 | 10464 | 10479 | 215 |
| 586702 | 1552 | 1567 | TAGACAGTGACTTTAA | 83 | 10524 | 10539 | 216 |
| 586703 | 1554 | 1569 | AATAGACAGTGACTTT | 70 | 10526 | 10541 | 3358 |
| 586704 | 1605 | 1620 | AGAAATGTAAACGGTA | 76 | 10577 | 10592 | 3359 |
| 586705 | 1607 | 1622 | TGAGAAATGTAAACGG | 83 | 10579 | 10594 | 217 |
| 586706 | 1762 | 1777 | TCATATGATGCCTTTT | 69 | 10734 | 10749 | 3360 |
| 586707 | 1764 | 1779 | GCTCATATGATGCCTT | 84 | 10736 | 10751 | 218 |
| 586708 | 1766 | 1781 | TAGCTCATATGATGCC | 83 | 10738 | 10753 | 222 |
| 561567 | 1767 | 1782 | TTAGCTCATATGATGC | 81 | 10739 | 10754 | 177 |
| 586709 | 1768 | 1783 | ATTAGCTCATATGATG | 40 | 10740 | 10755 | 3361 |
| 586710 | 1774 | 1789 | TGTGATATTAGCTCAT | 73 | 10746 | 10761 | 3362 |
| 586711 | 1776 | 1791 | GTTGTGATATTAGCTC | 80 | 10748 | 10763 | 3363 |

TABLE 25-continued

Inhibition of ANGPTL3 mRNA by deoxy, MOE and (S)-cEt gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 586712 | 1905 | 1920 | TACTCTGTGCTGACGA | 81 | 10877 | 10892 | 3364 |
| 586713 | 1907 | 1922 | CATACTCTGTGCTGAC | 81 | 10879 | 10894 | 3365 |
| 586714 | 2052 | 2067 | GTTTAAAGACAGCGAA | 72 | 11024 | 11039 | 3366 |
| 586715 | 2054 | 2069 | TTGTTTAAAGACAGCG | 81 | 11026 | 11041 | 3367 |
| 586716 | 2068 | 2083 | GTAGTCATCTCCATTT | 63 | 11040 | 11055 | 3368 |
| 586717 | 2070 | 2085 | TAGTAGTCATCTCCAT | 74 | 11042 | 11057 | 3369 |
| 561650 | 2071 | 2086 | TTAGTAGTCATCTCCA | 79 | 11043 | 11058 | 142 |
| 586718 | 2072 | 2087 | CTTAGTAGTCATCTCC | 84 | 11044 | 11059 | 219 |

Example 5: Antisense Inhibition of Human ANGPTL3 in Hep3B Cells by Deoxy, MOE and (S)-cEt Gapmers Additional antisense oligonucleotides were designed targeting an ANGPTL3 nucleic acid and were tested for their effects on ANGPTL3 mRNA in vitro. ISIS 337487 and ISIS 233717, which are 5-10-5 MOE gapmers, were also included in the assay as benchmark oligonucleotides. Cultured Hep3B cells at a density of 20,000 cells per well were transfected using electroporation with 4,500 nM antisense oligonucleotide. After a treatment period of approximately 24 hours, RNA was isolated from the cells and ANGPTL3 mRNA levels were measured by quantitative real-time PCR. Human primer probe set RTS3492_MGB was used to measure mRNA levels. ANGPTL3 mRNA levels were adjusted according to total RNA content, as measured by RIBOGREEN®. Results are presented as percent inhibition of ANGPTL3, relative to untreated control cells.

The newly designed chimeric antisense oligonucleotides in the Tables below were designed as deoxy, MOE, and (S)-cEt oligonucleotides or 5-10-5 MOE gapmers. The deoxy, MOE and (S)-cEt oligonucleotides are 16 nucleosides in length wherein the nucleoside have either a MOE sugar modification, an (S)-cEt sugar modification, or a deoxy sugar residue. The sugar modifications of each antisense oligonucleotide is described as 'eek-d10-kke', where 'k' indicates an (S)-cEt sugar modification; 'd' indicates deoxyribose; the number indicates the number of deoxyribose sugars residues; and 'e' indicates a MOE modification. The 5-10-5 MOE gapmers are 20 nucleosides in length, wherein the central gap segment comprises often 2'-deoxynucleosides and is flanked by wing segments on the 5' direction and the 3' direction comprising five nucleosides each. The internucleoside linkages throughout each oligonucleotide are phosphorothioate (P=S) linkages. All cytosine residues throughout each oligonucleotide are 5-methylcytosines. "Start site" indicates the 5'-most nucleoside to which the oligonucleotide is targeted in the human gene sequence. "Stop site" indicates the 3'-most nucleoside to which the oligonucleotide is targeted human gene sequence. Each oligonucleotide listed in the Tables below is targeted to either the human ANGPTL3 mRNA, designated herein as SEQ ID NO: 1 (GENBANK Accession No. NM_014495.2) or the human ANGPTL3 genomic sequence, designated herein as SEQ ID NO: 2 (GENBANK Accession No. NT_032977.9 truncated from nucleotides 33032001 to 33046000). 'n/a' indicates that the antisense oligonucleotide does not target that particular gene sequence with 100% complementarity.

TABLE 26

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561671 | N/A | N/A | TCTTAACTCTATATAT | Deoxy, MOE, and cEt | 12 | 3076 | 3091 | 3370 |
| 561672 | N/A | N/A | CTTCTTAACTCTATAT | Deoxy, MOE, and cEt | 12 | 3078 | 3093 | 3371 |
| 561673 | N/A | N/A | GACTTCTTAACTCTAT | Deoxy, MOE, and cEt | 18 | 3080 | 3095 | 3372 |
| 561674 | N/A | N/A | TAGACTTCTTAACTCT | Deoxy, MOE, and cEt | 20 | 3082 | 3097 | 3373 |
| 561675 | N/A | N/A | CCTAGACTTCTTAACT | Deoxy, MOE, and cEt | 9 | 3084 | 3099 | 3374 |

TABLE 26-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561676 | N/A | N/A | GACCTAGACTTCTTAA | Deoxy, MOE, and cEt | 0 | 3086 | 3101 | 3375 |
| 561677 | N/A | N/A | CAGACCTAGACTTCTT | Deoxy, MOE, and cEt | 18 | 3088 | 3103 | 3376 |
| 561678 | N/A | N/A | AGCAGACCTAGACTTC | Deoxy, MOE, and cEt | 26 | 3090 | 3105 | 3377 |
| 561679 | N/A | N/A | GAAGCAGACCTAGACT | Deoxy, MOE, and cEt | 24 | 3092 | 3107 | 3378 |
| 561680 | N/A | N/A | TGGAAGCAGACCTAGA | Deoxy, MOE, and cEt | 30 | 3094 | 3109 | 3379 |
| 561758 | N/A | N/A | CTTTAACAAATGGGTT | Deoxy, MOE, and cEt | 25 | 11539 | 11554 | 3380 |
| 561759 | N/A | N/A | ATCCTTTAACAAATGG | Deoxy, MOE, and cEt | 31 | 11542 | 11557 | 3381 |
| 561760 | N/A | N/A | CTATATCCTTTAACAA | Deoxy, MOE, and cEt | 28 | 11546 | 11561 | 3382 |
| 561761 | N/A | N/A | GCACTATATCCTTTAA | Deoxy, MOE, and cEt | 59 | 11549 | 11564 | 3383 |
| 561762 | N/A | N/A | TGGGCACTATATCCTT | Deoxy, MOE, and cEt | 34 | 11552 | 11567 | 3384 |
| 561763 | N/A | N/A | ACTTGGGCACTATATC | Deoxy, MOE, and cEt | 30 | 11555 | 11570 | 3385 |
| 561764 | N/A | N/A | ATAACTTGGGCACTAT | Deoxy, MOE, and cEt | 51 | 11558 | 11573 | 3386 |
| 561765 | N/A | N/A | CATATAACTTGGGCAC | Deoxy, MOE, and cEt | 47 | 11561 | 11576 | 3387 |
| 561766 | N/A | N/A | CACCATATAACTTGGG | Deoxy, MOE, and cEt | 47 | 11564 | 11579 | 3388 |
| 561767 | N/A | N/A | GGTCACCATATAACTT | Deoxy, MOE, and cEt | 58 | 11567 | 11582 | 3389 |
| 561768 | N/A | N/A | GTAGGTCACCATATAA | Deoxy, MOE, and cEt | 62 | 11570 | 11585 | 3390 |
| 561769 | N/A | N/A | AAGGTAGGTCACCATA | Deoxy, MOE, and cEt | 65 | 11573 | 11588 | 3391 |
| 561770 | N/A | N/A | ACAAAGGTAGGTCACC | Deoxy, MOE, and cEt | 73 | 11576 | 11591 | 143 |
| 561771 | N/A | N/A | TTGACAAAGGTAGGTC | Deoxy, MOE, and cEt | 70 | 11579 | 11594 | 3392 |
| 561772 | N/A | N/A | GTATTGACAAAGGTAG | Deoxy, MOE, and cEt | 58 | 11582 | 11597 | 3393 |
| 561773 | N/A | N/A | TAAGTATTGACAAAGG | Deoxy, MOE, and cEt | 42 | 11585 | 11600 | 3394 |
| 561774 | N/A | N/A | TGCTAAGTATTGACAA | Deoxy, MOE, and cEt | 51 | 11588 | 11603 | 3395 |
| 561775 | N/A | N/A | TAATGCTAAGTATTGA | Deoxy, MOE, and cEt | 42 | 11591 | 11606 | 3396 |
| 561776 | N/A | N/A | TACATAATGCTAAGTA | Deoxy, MOE, and cEt | 36 | 11595 | 11610 | 3397 |
| 561777 | N/A | N/A | GGATAATTTGAAATAC | Deoxy, MOE, and cEt | 24 | 11608 | 11623 | 3398 |
| 561778 | N/A | N/A | TATTGGATAATTTGAA | Deoxy, MOE, and cEt | 35 | 11612 | 11627 | 3399 |
| 561779 | N/A | N/A | GTATATTGGATAATTT | Deoxy, MOE, and cEt | 0 | 11615 | 11630 | 3400 |
| 561780 | N/A | N/A | CATGTATATTGGATAA | Deoxy, MOE, and cEt | 20 | 11618 | 11633 | 3401 |
| 561781 | N/A | N/A | TGACATGTATATTGGA | Deoxy, MOE, and cEt | 73 | 11621 | 11636 | 144 |
| 561782 | N/A | N/A | CTTTTATATATGTGAC | Deoxy, MOE, and cEt | 37 | 11652 | 11667 | 3402 |
| 561783 | N/A | N/A | GATCATACATATCTTT | Deoxy, MOE, and cEt | 51 | 11664 | 11679 | 3403 |
| 561784 | N/A | N/A | ATAGATCATACATATC | Deoxy, MOE, and cEt | 46 | 11667 | 11682 | 3404 |
| 561785 | N/A | N/A | CACATAGATCATACAT | Deoxy, MOE, and cEt | 65 | 11670 | 11685 | 3405 |
| 561786 | N/A | N/A | ATTCACATAGATCATA | Deoxy, MOE, and cEt | 48 | 11673 | 11688 | 3406 |
| 561787 | N/A | N/A | AGGATTCACATAGATC | Deoxy, MOE, and cEt | 48 | 11676 | 11691 | 3407 |
| 561788 | N/A | N/A | CTTAGGATTCACATAG | Deoxy, MOE, and cEt | 42 | 11679 | 11694 | 3408 |

TABLE 26-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561789 | N/A | N/A | TTACTTAGGATTCACA | Deoxy, MOE, and cEt | 58 | 11682 | 11697 | 3409 |
| 561790 | N/A | N/A | TATTTACTTAGGATTC | Deoxy, MOE, and cEt | 45 | 11685 | 11700 | 3410 |
| 561791 | N/A | N/A | GTACTTTTCTGGAACA | Deoxy, MOE, and cEt | 77 | 11704 | 11719 | 145 |
| 561792 | N/A | N/A | CCTGAAAATTATAGAT | Deoxy, MOE, and cEt | 35 | 11741 | 11756 | 3411 |
| 561793 | N/A | N/A | GGTCCTGAAAATTATA | Deoxy, MOE, and cEt | 32 | 11744 | 11759 | 3412 |
| 561794 | N/A | N/A | TGTGGTCCTGAAAATT | Deoxy, MOE, and cEt | 45 | 11747 | 11762 | 3413 |
| 561795 | N/A | N/A | GTCTGTGGTCCTGAAA | Deoxy, MOE, and cEt | 47 | 11750 | 11765 | 3414 |
| 561796 | N/A | N/A | TTAGTCTGTGGTCCTG | Deoxy, MOE, and cEt | 67 | 11753 | 11768 | 3415 |
| 561797 | N/A | N/A | AGCTTAGTCTGTGGTC | Deoxy, MOE, and cEt | 55 | 11756 | 11771 | 3416 |
| 561798 | N/A | N/A | GACAGCTTAGTCTGTG | Deoxy, MOE, and cEt | 47 | 11759 | 11774 | 3417 |
| 561799 | N/A | N/A | TTCGACAGCTTAGTCT | Deoxy, MOE, and cEt | 68 | 11762 | 11777 | 3418 |
| 561800 | N/A | N/A | AATTTCGACAGCTTAG | Deoxy, MOE, and cEt | 61 | 11765 | 11780 | 3419 |
| 561801 | N/A | N/A | GTTAATTTCGACAGCT | Deoxy, MOE, and cEt | 70 | 11768 | 11783 | 3420 |
| 561802 | N/A | N/A | CCTAAAAAAATCAGCG | Deoxy, MOE, and cEt | 19 | 11783 | 11798 | 3421 |
| 561803 | N/A | N/A | GGCCCTAAAAAAATCA | Deoxy, MOE, and cEt | 0 | 11786 | 11801 | 3422 |
| 561804 | N/A | N/A | TTCTGGCCCTAAAAAA | Deoxy, MOE, and cEt | 10 | 11790 | 11805 | 3423 |
| 561805 | N/A | N/A | GTATTCTGGCCCTAAA | Deoxy, MOE, and cEt | 44 | 11793 | 11808 | 3424 |
| 561806 | N/A | N/A | TTGGTATTCTGGCCCT | Deoxy, MOE, and cEt | 45 | 11796 | 11811 | 3425 |
| 561807 | N/A | N/A | ATTTTGGTATTCTGGC | Deoxy, MOE, and cEt | 59 | 11799 | 11814 | 3426 |
| 561808 | N/A | N/A | GCCATTTTGGTATTCT | Deoxy, MOE, and cEt | 58 | 11802 | 11817 | 3427 |
| 561809 | N/A | N/A | GGAGCCATTTTGGTAT | Deoxy, MOE, and cEt | 33 | 11805 | 11820 | 3428 |
| 561810 | N/A | N/A | AGAGGAGCCATTTTGG | Deoxy, MOE, and cEt | 36 | 11808 | 11823 | 3429 |
| 561811 | N/A | N/A | AAGAGAGGAGCCATTT | Deoxy, MOE, and cEt | 14 | 11811 | 11826 | 3430 |
| 561812 | N/A | N/A | ATTGTCCAATTTTGGG | Deoxy, MOE, and cEt | 25 | 11829 | 11844 | 3431 |
| 561813 | N/A | N/A | GAAATTGTCCAATTTT | Deoxy, MOE, and cEt | 38 | 11832 | 11847 | 3432 |
| 561814 | N/A | N/A | TTTGAAATTGTCCAAT | Deoxy, MOE, and cEt | 36 | 11835 | 11850 | 3433 |
| 561815 | N/A | N/A | GCATTTGAAATTGTCC | Deoxy, MOE, and cEt | 67 | 11838 | 11853 | 3434 |
| 561816 | N/A | N/A | GCAACTCATATATTAA | Deoxy, MOE, and cEt | 57 | 11869 | 11884 | 3435 |
| 561817 | N/A | N/A | GAAGCAACTCATATAT | Deoxy, MOE, and cEt | 46 | 11872 | 11887 | 3436 |
| 561818 | N/A | N/A | GAGGAAGCAACTCATA | Deoxy, MOE, and cEt | 14 | 11875 | 11890 | 3437 |
| 561819 | N/A | N/A | ATAGAGGAAGCAACTC | Deoxy, MOE, and cEt | 60 | 11878 | 11893 | 3438 |
| 561820 | N/A | N/A | CAAATAGAGGAAGCAA | Deoxy, MOE, and cEt | 36 | 11881 | 11896 | 3439 |
| 561821 | N/A | N/A | AACCAAATAGAGGAAG | Deoxy, MOE, and cEt | 38 | 11884 | 11899 | 3440 |
| 561822 | N/A | N/A | GGAAACCAAATAGAGG | Deoxy, MOE, and cEt | 51 | 11887 | 11902 | 3441 |
| 561823 | N/A | N/A | CTTTAAGTGAAGTTAC | Deoxy, MOE, and cEt | 30 | 3636 | 3651 | 3442 |
| 561824 | N/A | N/A | TACTTACTTTAAGTGA | Deoxy, MOE, and cEt | 27 | 3642 | 3657 | 3443 |

TABLE 26-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561825 | N/A | N/A | GAACCCTCTTTATTTT | Deoxy, MOE, and cEt | 25 | 3659 | 3674 | 3444 |
| 561826 | N/A | N/A | AAACATGAACCCTCTT | Deoxy, MOE, and cEt | 14 | 3665 | 3680 | 3445 |
| 561827 | N/A | N/A | GATCCACATTGAAAAC | Deoxy, MOE, and cEt | 0 | 3683 | 3698 | 3446 |
| 561828 | N/A | N/A | CATGCCTTAGAAATAT | Deoxy, MOE, and cEt | 33 | 3710 | 3725 | 3447 |
| 561829 | N/A | N/A | AAATGGCATGCCTTAG | Deoxy, MOE, and cEt | 46 | 3716 | 3731 | 3448 |
| 561830 | N/A | N/A | GTATTTCAAATGGCAT | Deoxy, MOE, and cEt | 54 | 3723 | 3738 | 3449 |
| 561831 | N/A | N/A | GCAACAAAGTATTTCA | Deoxy, MOE, and cEt | 60 | 3731 | 3746 | 3450 |
| 561832 | N/A | N/A | GTATTTCAACAATGCA | Deoxy, MOE, and cEt | 28 | 3744 | 3759 | 3451 |
| 561833 | N/A | N/A | ATAACATTAGGGAAAC | Deoxy, MOE, and cEt | 18 | 3827 | 3842 | 3452 |
| 561834 | N/A | N/A | TCATATATAACATTAG | Deoxy, MOE, and cEt | 18 | 3833 | 3848 | 3453 |
| 561912 | N/A | N/A | GTGGTTTTGAGCAAAG | Deoxy, MOE, and cEt | 5 | 4736 | 4751 | 3454 |
| 561913 | N/A | N/A | CTATTGTGTGGTTTTG | Deoxy, MOE, and cEt | 36 | 4743 | 4758 | 3455 |
| 561914 | N/A | N/A | GGAAAGCTATTGTGTG | Deoxy, MOE, and cEt | 18 | 4749 | 4764 | 3456 |
| 561915 | N/A | N/A | TATGAGTGAAATGGAA | Deoxy, MOE, and cEt | 13 | 4761 | 4776 | 3457 |
| 561916 | N/A | N/A | AGCCAATATGAGTGAA | Deoxy, MOE, and cEt | 57 | 4767 | 4782 | 3458 |
| 561917 | N/A | N/A | CTAAAGAGCCAATATG | Deoxy, MOE, and cEt | 33 | 4773 | 4788 | 3459 |
| 561918 | N/A | N/A | CTTGGTCTAAAGAGCC | Deoxy, MOE, and cEt | 70 | 4779 | 4794 | 146 |
| 561919 | N/A | N/A | GGTAATCTTGGTCTAA | Deoxy, MOE, and cEt | 46 | 4785 | 4800 | 3460 |
| 561920 | N/A | N/A | GATGACGAAGGGTTGG | Deoxy, MOE, and cEt | 28 | 4800 | 4815 | 3461 |
| 561921 | N/A | N/A | CAGTGAGATGACGAAG | Deoxy, MOE, and cEt | 39 | 4806 | 4821 | 3462 |
| 561922 | N/A | N/A | TGAAGTCAGTGAGATG | Deoxy, MOE, and cEt | 49 | 4812 | 4827 | 3463 |
| 561923 | N/A | N/A | AGGAGGTGAAGTCAGT | Deoxy, MOE, and cEt | 35 | 4818 | 4833 | 3464 |
| 561924 | N/A | N/A | GAGTAGAGGAGGTGAA | Deoxy, MOE, and cEt | 33 | 4824 | 4839 | 3465 |
| 561925 | N/A | N/A | TAACTAGAGTAGAGGA | Deoxy, MOE, and cEt | 35 | 4830 | 4845 | 3466 |
| 561926 | N/A | N/A | TCAGAATAACTAGAGT | Deoxy, MOE, and cEt | 24 | 4836 | 4851 | 3467 |
| 561927 | N/A | N/A | AAGCGGTCAGAATAAC | Deoxy, MOE, and cEt | 39 | 4842 | 4857 | 3468 |
| 561928 | N/A | N/A | CTGGTAAAGCGGTCAG | Deoxy, MOE, and cEt | 51 | 4848 | 4863 | 3469 |
| 561929 | N/A | N/A | TGAATACTGGTAAAGC | Deoxy, MOE, and cEt | 63 | 4854 | 4869 | 3470 |
| 561930 | N/A | N/A | TGTGTTTGAATACTGG | Deoxy, MOE, and cEt | 65 | 4860 | 4875 | 3471 |
| 561931 | N/A | N/A | GTTTGATGTGTTTGAA | Deoxy, MOE, and cEt | 49 | 4866 | 4881 | 3472 |
| 561932 | N/A | N/A | CAGTATGTTTGATGTG | Deoxy, MOE, and cEt | 48 | 4872 | 4887 | 3473 |
| 561933 | N/A | N/A | AGGTGGCAGTATGTTT | Deoxy, MOE, and cEt | 0 | 4878 | 4893 | 3474 |
| 561934 | N/A | N/A | GCTTTGAGGTGGCAGT | Deoxy, MOE, and cEt | 48 | 4884 | 4899 | 3475 |
| 561935 | N/A | N/A | GGGCAAAGGCTTTGAG | Deoxy, MOE, and cEt | 28 | 4892 | 4907 | 3476 |
| 561936 | N/A | N/A | CAACAGGGCAAAGGC | Deoxy, MOE, and cEt | 65 | 4898 | 4913 | 3477 |
| 561937 | N/A | N/A | GAGGAAACAACAAGGG | Deoxy, MOE, and cEt | 42 | 4905 | 4920 | 3478 |

TABLE 26-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561938 | N/A | N/A | CCAGTTAGAGGAAACA | Deoxy, MOE, and cEt | 52 | 4912 | 4927 | 3479 |
| 561939 | N/A | N/A | CCAGGGCAGAAGAGCG | Deoxy, MOE, and cEt | 61 | 4930 | 4945 | 3480 |
| 561940 | N/A | N/A | TAGATACCAGGGCAGA | Deoxy, MOE, and cEt | 68 | 4936 | 4951 | 3481 |
| 561941 | N/A | N/A | CAGAGAGTGGGCCACG | Deoxy, MOE, and cEt | 46 | 4952 | 4967 | 3482 |
| 561942 | N/A | N/A | GGAAATCAGAGAGTGG | Deoxy, MOE, and cEt | 42 | 4958 | 4973 | 3483 |
| 561943 | N/A | N/A | CCTAAGGGAAATCAGA | Deoxy, MOE, and cEt | 26 | 4964 | 4979 | 3484 |
| 561944 | N/A | N/A | AACGACCCTAAGGGAA | Deoxy, MOE, and cEt | 45 | 4970 | 4985 | 3485 |
| 561945 | N/A | N/A | TTTGATAACGACCCTA | Deoxy, MOE, and cEt | 57 | 4976 | 4991 | 3486 |
| 561946 | N/A | N/A | TTTTTGTTTGATAACG | Deoxy, MOE, and cEt | 21 | 4982 | 4997 | 3487 |
| 561947 | N/A | N/A | CATTGGGAATTTTTTG | Deoxy, MOE, and cEt | 35 | 4992 | 5007 | 3488 |
| 561948 | N/A | N/A | AGTCTTCATTGGGAAT | Deoxy, MOE, and cEt | 69 | 4998 | 5013 | 3489 |
| 561949 | N/A | N/A | CTTGTAAGTCTTCATT | Deoxy, MOE, and cEt | 35 | 5004 | 5019 | 3490 |
| 561950 | N/A | N/A | AGTGACCTTGTAAGTC | Deoxy, MOE, and cEt | 56 | 5010 | 5025 | 3491 |
| 561951 | N/A | N/A | TGGTTAAGTGACCTTG | Deoxy, MOE, and cEt | 67 | 5016 | 5031 | 3492 |
| 561952 | N/A | N/A | GATTTTGGTTAAGTG | Deoxy, MOE, and cEt | 43 | 5022 | 5037 | 3493 |
| 561953 | N/A | N/A | GGTTGTGATTTTTGGT | Deoxy, MOE, and cEt | 58 | 5028 | 5043 | 3494 |
| 561954 | N/A | N/A | CCAGGCGGTTGTGATT | Deoxy, MOE, and cEt | 49 | 5034 | 5049 | 3495 |
| 561955 | N/A | N/A | ATGGGACCAGGCGGTT | Deoxy, MOE, and cEt | 52 | 5040 | 5055 | 3496 |
| 561956 | N/A | N/A | AAGTTTTCAGGGATGG | Deoxy, MOE, and cEt | 49 | 5052 | 5067 | 3497 |
| 561957 | N/A | N/A | AAGTAGAAGTTTTCAG | Deoxy, MOE, and cEt | 16 | 5058 | 5073 | 3498 |
| 561958 | N/A | N/A | CTAAGGAAGTAGAAGT | Deoxy, MOE, and cEt | 33 | 5064 | 5079 | 3499 |
| 561959 | N/A | N/A | AAGTAGCTAAGGAAGT | Deoxy, MOE, and cEt | 35 | 5070 | 5085 | 3500 |
| 561960 | N/A | N/A | GGAGAAAAGTAGCTAA | Deoxy, MOE, and cEt | 36 | 5076 | 5091 | 3501 |
| 561961 | N/A | N/A | TGTGCAGGAGAAAAGT | Deoxy, MOE, and cEt | 53 | 5082 | 5097 | 3502 |
| 561962 | N/A | N/A | GGTGAGTGTGCAGGAG | Deoxy, MOE, and cEt | 44 | 5088 | 5103 | 3503 |
| 561963 | N/A | N/A | AATAAGGTGAGTGTG | Deoxy, MOE, and cEt | 38 | 5094 | 5109 | 3504 |
| 561964 | N/A | N/A | TGCAGGAATAGAAGAG | Deoxy, MOE, and cEt | 58 | 5138 | 5153 | 3505 |
| 561965 | N/A | N/A | TTTTAGTGCAGGAATA | Deoxy, MOE, and cEt | 20 | 5144 | 5159 | 3506 |
| 561966 | N/A | N/A | TATTCACAGAGCTTAC | Deoxy, MOE, and cEt | 63 | 5161 | 5176 | 3507 |
| 561967 | N/A | N/A | TCCCTGTATTCACAGA | Deoxy, MOE, and cEt | 61 | 5167 | 5182 | 3508 |
| 561968 | N/A | N/A | GAAAAAATCCCTGTAT | Deoxy, MOE, and cEt | 22 | 5174 | 5189 | 3509 |
| 561969 | N/A | N/A | TATGAAGATAATGGAA | Deoxy, MOE, and cEt | 34 | 5187 | 5202 | 3510 |
| 561970 | N/A | N/A | GGAGTATATACAAATA | Deoxy, MOE, and cEt | 46 | 5211 | 5226 | 3511 |
| 561971 | N/A | N/A | TATTCTGGAGTATATA | Deoxy, MOE, and cEt | 29 | 5217 | 5232 | 3512 |
| 561972 | N/A | N/A | ATTCTATATTCTGGAG | Deoxy, MOE, and cEt | 58 | 5223 | 5238 | 3513 |
| 561973 | N/A | N/A | CATACAGTATTCTATA | Deoxy, MOE, and cEt | 39 | 5231 | 5246 | 3514 |

TABLE 26-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561974 | N/A | N/A | GTGTGCCATACAGTAT | Deoxy, MOE, and cEt | 48 | 5237 | 5252 | 3515 |
| 561975 | N/A | N/A | AGAAATGCCTACTGTG | Deoxy, MOE, and cEt | 34 | 5250 | 5265 | 3516 |
| 561976 | N/A | N/A | ATTCAACAGAAATGCC | Deoxy, MOE, and cEt | 52 | 5257 | 5272 | 3517 |
| 561977 | N/A | N/A | GAATATGACATTACAT | Deoxy, MOE, and cEt | 33 | 5279 | 5294 | 3518 |
| 561978 | N/A | N/A | CTGTGTGAATATGACA | Deoxy, MOE, and cEt | 63 | 5285 | 5300 | 3519 |
| 561979 | N/A | N/A | ACGCTTCTGTGTGAAT | Deoxy, MOE, and cEt | 59 | 5291 | 5306 | 3520 |
| 561980 | N/A | N/A | TAGCACACGCTTCTGT | Deoxy, MOE, and cEt | 29 | 5297 | 5312 | 3521 |
| 561981 | N/A | N/A | TAATCATAGCACACGC | Deoxy, MOE, and cEt | 64 | 5303 | 5318 | 3522 |
| 561982 | N/A | N/A | CCAAGTAATAATAATC | Deoxy, MOE, and cEt | 26 | 5314 | 5329 | 3523 |
| 561983 | N/A | N/A | AGTAATCCAAGTAATA | Deoxy, MOE, and cEt | 33 | 5320 | 5335 | 3524 |
| 561984 | N/A | N/A | ATTTCTAGTAATCCAA | Deoxy, MOE, and cEt | 42 | 5326 | 5341 | 3525 |
| 561985 | N/A | N/A | CACACTATTTCTAGTA | Deoxy, MOE, and cEt | 40 | 5332 | 5347 | 3526 |
| 561986 | N/A | N/A | ATGAGGCACACTATTT | Deoxy, MOE, and cEt | 47 | 5338 | 5353 | 3527 |
| 561987 | N/A | N/A | TTAATTATGAGGCACA | Deoxy, MOE, and cEt | 58 | 5344 | 5359 | 3528 |
| 561988 | N/A | N/A | TGACCTTTAATTATGA | Deoxy, MOE, and cEt | 38 | 5350 | 5365 | 3529 |
| 562066 | N/A | N/A | GCAATTTATTGAATGA | Deoxy, MOE, and cEt | 27 | 6083 | 6098 | 3530 |
| 562067 | N/A | N/A | GGGTTTGCAATTTATT | Deoxy, MOE, and cEt | 38 | 6089 | 6104 | 3531 |
| 562068 | N/A | N/A | TGTGTTGGGTTTGCAA | Deoxy, MOE, and cEt | 43 | 6095 | 6110 | 3532 |
| 562069 | N/A | N/A | TTTAAGTGTGTTGGGT | Deoxy, MOE, and cEt | 71 | 6101 | 6116 | 3533 |
| 562070 | N/A | N/A | GTTTAGCAGTAACATT | Deoxy, MOE, and cEt | 38 | 6126 | 6141 | 3534 |
| 562071 | N/A | N/A | ATTCAGTAGTTTATCG | Deoxy, MOE, and cEt | 17 | 6145 | 6160 | 3535 |
| 562072 | N/A | N/A | CTATATATTCAGTAGT | Deoxy, MOE, and cEt | 0 | 6151 | 6166 | 3536 |
| 562073 | N/A | N/A | GCTTACTTTCTATATA | Deoxy, MOE, and cEt | 21 | 6160 | 6175 | 3537 |
| 562074 | N/A | N/A | AGTTTGTTTGCTTACT | Deoxy, MOE, and cEt | 63 | 6169 | 6184 | 3538 |
| 562075 | N/A | N/A | TTGGCAAGTTTGTTTG | Deoxy, MOE, and cEt | 55 | 6175 | 6190 | 3539 |
| 562076 | N/A | N/A | GGCAGGTTGGCAAGTT | Deoxy, MOE, and cEt | 68 | 6181 | 6196 | 3540 |
| 562077 | N/A | N/A | GATGTTGGCAGGTTGG | Deoxy, MOE, and cEt | 54 | 6187 | 6202 | 3541 |
| 562078 | N/A | N/A | TCTGTAGATGTTGGCA | Deoxy, MOE, and cEt | 81 | 6193 | 6208 | 147 |
| 562079 | N/A | N/A | AACATATCTGTAGATG | Deoxy, MOE, and cEt | 32 | 6199 | 6214 | 3542 |
| 562080 | N/A | N/A | CCTGTAAACATATCTG | Deoxy, MOE, and cEt | 51 | 6205 | 6220 | 3543 |
| 562081 | N/A | N/A | TTTTGACCTGTAAACA | Deoxy, MOE, and cEt | 14 | 6211 | 6226 | 3544 |
| 562082 | N/A | N/A | GATAATTTTTGACCTG | Deoxy, MOE, and cEt | 49 | 6217 | 6232 | 3545 |
| 562083 | N/A | N/A | TCTTGATAATTTGATA | Deoxy, MOE, and cEt | 13 | 6229 | 6244 | 3546 |
| 562084 | N/A | N/A | AGGCTTTCTTGATAAT | Deoxy, MOE, and cEt | 55 | 6235 | 6250 | 3547 |
| 562085 | N/A | N/A | TGAACCAGGCTTTCTT | Deoxy, MOE, and cEt | 74 | 6241 | 6256 | 3548 |
| 562086 | N/A | N/A | ATAATTTGAACCAGGC | Deoxy, MOE, and cEt | 82 | 6247 | 6262 | 148 |

TABLE 26-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 562087 | N/A | N/A | GATAAAGACATAATAC | Deoxy, MOE, and cEt | 21 | 6263 | 6278 | 3549 |
| 562088 | N/A | N/A | ACCTGTGATAAAGACA | Deoxy, MOE, and cEt | 27 | 6269 | 6284 | 3550 |
| 562089 | N/A | N/A | CTTCAGACCTGTGATA | Deoxy, MOE, and cEt | 23 | 6275 | 6290 | 3551 |
| 562090 | N/A | N/A | ACTGATCTTCAGACCT | Deoxy, MOE, and cEt | 48 | 6281 | 6296 | 3552 |
| 562091 | N/A | N/A | GGTCTTACTGATCTTC | Deoxy, MOE, and cEt | 59 | 6287 | 6302 | 3553 |
| 562092 | N/A | N/A | GTTTTAGGTCTTACTG | Deoxy, MOE, and cEt | 21 | 6293 | 6308 | 3554 |
| 562093 | N/A | N/A | GTTCAGATTTTAAGTT | Deoxy, MOE, and cEt | 31 | 6321 | 6336 | 3555 |
| 562094 | N/A | N/A | ATATTCTGTTCAGATT | Deoxy, MOE, and cEt | 36 | 6328 | 6343 | 3556 |
| 562095 | N/A | N/A | ATATTGTAATGTATTC | Deoxy, MOE, and cEt | 52 | 6372 | 6387 | 3557 |
| 562096 | N/A | N/A | CTTAGAATATTGTAAT | Deoxy, MOE, and cEt | 13 | 6378 | 6393 | 3558 |
| 562097 | N/A | N/A | GCTTTGCTTAGAATAT | Deoxy, MOE, and cEt | 47 | 6384 | 6399 | 3559 |
| 562098 | N/A | N/A | GAGACTGCTTTGCTTA | Deoxy, MOE, and cEt | 48 | 6390 | 6405 | 3560 |
| 562099 | N/A | N/A | AAAGTAGAGACTGCTT | Deoxy, MOE, and cEt | 44 | 6396 | 6411 | 3561 |
| 562100 | N/A | N/A | AGGCCAAAAGTAGAGA | Deoxy, MOE, and cEt | 59 | 6402 | 6417 | 3562 |
| 562101 | N/A | N/A | TCGGAAAACAGAGCAA | Deoxy, MOE, and cEt | 63 | 6417 | 6432 | 3563 |
| 562102 | N/A | N/A | CATTGGTCGGAAAACA | Deoxy, MOE, and cEt | 53 | 6423 | 6438 | 3564 |
| 562103 | N/A | N/A | AGCAGACATTGGTCGG | Deoxy, MOE, and cEt | 83 | 6429 | 6444 | 149 |
| 562104 | N/A | N/A | AGCAAGGCAAAAAAGC | Deoxy, MOE, and cEt | 22 | 6442 | 6457 | 3565 |
| 562105 | N/A | N/A | GACATTATTTAATAAG | Deoxy, MOE, and cEt | 21 | 6470 | 6485 | 3566 |
| 562106 | N/A | N/A | ATCAGGGACATTATTT | Deoxy, MOE, and cEt | 34 | 6476 | 6491 | 3567 |
| 562107 | N/A | N/A | TATTTAATCAGGGACA | Deoxy, MOE, and cEt | 47 | 6482 | 6497 | 3568 |
| 562108 | N/A | N/A | ATTACCTGTTCTCAAA | Deoxy, MOE, and cEt | 30 | 6499 | 6514 | 3569 |
| 562109 | N/A | N/A | GTACAGATTACCTGTT | Deoxy, MOE, and cEt | 38 | 6505 | 6520 | 3570 |
| 562110 | N/A | N/A | CAGATTGTACAGATTA | Deoxy, MOE, and cEt | 76 | 6511 | 6526 | 150 |
| 562111 | N/A | N/A | GTTATTCAGATTGTAC | Deoxy, MOE, and cEt | 32 | 6517 | 6532 | 3571 |
| 562112 | N/A | N/A | AACAGTGTTATTCAGA | Deoxy, MOE, and cEt | 58 | 6523 | 6538 | 3572 |
| 562113 | N/A | N/A | TAGATAAACAGTGTTA | Deoxy, MOE, and cEt | 33 | 6529 | 6544 | 3573 |
| 562114 | N/A | N/A | TGATATTTAGATAAAC | Deoxy, MOE, and cEt | 26 | 6536 | 6551 | 3574 |
| 562115 | N/A | N/A | GGTGTTTGATATTTAG | Deoxy, MOE, and cEt | 60 | 6542 | 6557 | 3575 |
| 562116 | N/A | N/A | TATAACGGTGTTTGAT | Deoxy, MOE, and cEt | 42 | 6548 | 6563 | 3576 |
| 562117 | N/A | N/A | TAATGTTATAACGGTG | Deoxy, MOE, and cEt | 62 | 6554 | 6569 | 3577 |
| 562118 | N/A | N/A | AGTTCATAATGTTATA | Deoxy, MOE, and cEt | 21 | 6560 | 6575 | 3578 |
| 562119 | N/A | N/A | GTCTTTCAGTTCATAA | Deoxy, MOE, and cEt | 57 | 6567 | 6582 | 3579 |
| 562120 | N/A | N/A | ACAGTTTGTCTTTCAG | Deoxy, MOE, and cEt | 59 | 6574 | 6589 | 3580 |
| 562121 | N/A | N/A | AGAAGTACAGTTTGTC | Deoxy, MOE, and cEt | 3 | 6580 | 6595 | 3581 |
| 562122 | N/A | N/A | GATGTCAGAAGTACAG | Deoxy, MOE, and cEt | 45 | 6586 | 6601 | 3582 |

TABLE 26-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 562123 | N/A | N/A | AGTAAGGATGTCAGAA | Deoxy, MOE, and cEt | 44 | 6592 | 6607 | 3583 |
| 562124 | N/A | N/A | AATCTGAGTAAGGATG | Deoxy, MOE, and cEt | 45 | 6598 | 6613 | 3584 |
| 562125 | N/A | N/A | GAATATACAATTAGGG | Deoxy, MOE, and cEt | 13 | 6616 | 6631 | 3585 |
| 562126 | N/A | N/A | TGATACTGAATATACA | Deoxy, MOE, and cEt | 13 | 6623 | 6638 | 3586 |
| 562127 | N/A | N/A | CTGAGCTGATAAAAGA | Deoxy, MOE, and cEt | 1 | 6660 | 6675 | 3587 |
| 562128 | N/A | N/A | ACCATCATGTTTTACA | Deoxy, MOE, and cEt | 44 | 6772 | 6787 | 3588 |
| 562129 | N/A | N/A | TGTCTTACCATCATGT | Deoxy, MOE, and cEt | 29 | 6778 | 6793 | 3589 |
| 562130 | N/A | N/A | CCAAAGTGTCTTACCA | Deoxy, MOE, and cEt | 42 | 6784 | 6799 | 3590 |
| 562131 | N/A | N/A | AACCCACCAAAGTGTC | Deoxy, MOE, and cEt | 33 | 6790 | 6805 | 3591 |
| 562132 | N/A | N/A | GAAGGAAACCCACCAA | Deoxy, MOE, and cEt | 24 | 6796 | 6811 | 3592 |
| 562133 | N/A | N/A | CTTCAAGAAGGAAACC | Deoxy, MOE, and cEt | 28 | 6802 | 6817 | 3593 |
| 562134 | N/A | N/A | TAATAGCTTCAAGAAG | Deoxy, MOE, and cEt | 1 | 6808 | 6823 | 3594 |
| 562135 | N/A | N/A | GGGAATTTGATAATAA | Deoxy, MOE, and cEt | 0 | 6821 | 6836 | 3595 |
| 562136 | N/A | N/A | AGAATAGGGAATTTGA | Deoxy, MOE, and cEt | 18 | 6827 | 6842 | 3596 |
| 562137 | N/A | N/A | GTCCTAAGAATAGGGA | Deoxy, MOE, and cEt | 9 | 6833 | 6848 | 3597 |
| 562138 | N/A | N/A | GAACAAGTCCTAAGAA | Deoxy, MOE, and cEt | 7 | 6839 | 6854 | 3598 |
| 562139 | N/A | N/A | AGTCTAGAACAAGTCC | Deoxy, MOE, and cEt | 70 | 6845 | 6860 | 3599 |
| 562140 | N/A | N/A | TCTTTTAGTCTAGAAC | Deoxy, MOE, and cEt | 22 | 6851 | 6866 | 3600 |
| 562141 | N/A | N/A | TAACTATCTTTTAGTC | Deoxy, MOE, and cEt | 15 | 6857 | 6872 | 3601 |
| 562142 | N/A | N/A | ATCTCTTAACTATCTT | Deoxy, MOE, and cEt | 35 | 6863 | 6878 | 3602 |
| 560991 | 3 | 18 | AACTGTTTTCTTCTGG | Deoxy, MOE, and cEt | 37 | 3107 | 3122 | 3603 |
| 560992 | 8 | 23 | CGTGGAACTGTTTTCT | Deoxy, MOE, and cEt | 74 | 3112 | 3127 | 112 |
| 560993 | 22 | 37 | TCAATTTCAAGCAACG | Deoxy, MOE, and cEt | 68 | 3126 | 3141 | 3604 |
| 560994 | 51 | 66 | CTTAATTGTGAACATT | Deoxy, MOE, and cEt | 21 | 3155 | 3170 | 3605 |
| 560995 | 53 | 68 | AGCTTAATTGTGAACA | Deoxy, MOE, and cEt | 59 | 3157 | 3172 | 3606 |
| 560996 | 55 | 70 | GGAGCTTAATTGTGAA | Deoxy, MOE, and cEt | 0 | 3159 | 3174 | 3607 |
| 560997 | 57 | 72 | AAGGAGCTTAATTGTG | Deoxy, MOE, and cEt | 36 | 3161 | 3176 | 3608 |
| 560998 | 59 | 74 | AGAAGGAGCTTAATTG | Deoxy, MOE, and cEt | 47 | 3163 | 3178 | 3609 |
| 560999 | 61 | 76 | AAAGAAGGAGCTTAAT | Deoxy, MOE, and cEt | 20 | 3165 | 3180 | 3610 |
| 561000 | 76 | 91 | CTAGAGGAACAATAAA | Deoxy, MOE, and cEt | 23 | 3180 | 3195 | 3611 |
| 561001 | 79 | 94 | TAACTAGAGGAACAAT | Deoxy, MOE, and cEt | 19 | 3183 | 3198 | 3612 |
| 561002 | 81 | 96 | AATAACTAGAGGAACA | Deoxy, MOE, and cEt | 38 | 3185 | 3200 | 3613 |
| 561003 | 84 | 99 | GGAAATAACTAGAGGA | Deoxy, MOE, and cEt | 48 | 3188 | 3203 | 3614 |
| 561004 | 86 | 101 | GAGGAAATAACTAGAG | Deoxy, MOE, and cEt | 37 | 3190 | 3205 | 3615 |
| 561005 | 88 | 103 | TGGAGGAAATAACTAG | Deoxy, MOE, and cEt | 68 | 3192 | 3207 | 3616 |
| 561006 | 90 | 105 | TCTGGAGGAAATAACT | Deoxy, MOE, and cEt | 49 | 3194 | 3209 | 3617 |

TABLE 26-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561007 | 94 | 109 | CAATTCTGGAGGAAAT | Deoxy, MOE, and cEt | 43 | 3198 | 3213 | 3618 |
| 561008 | 96 | 111 | ATCAATTCTGGAGGAA | Deoxy, MOE, and cEt | 73 | 3200 | 3215 | 3619 |
| 561009 | 98 | 113 | TGATCAATTCTGGAGG | Deoxy, MOE, and cEt | 72 | 3202 | 3217 | 3620 |
| 561010 | 100 | 115 | CTTGATCAATTCTGGA | Deoxy, MOE, and cEt | 82 | 3204 | 3219 | 113 |
| 561011 | 102 | 117 | GTCTTGATCAATTCTG | Deoxy, MOE, and cEt | 85 | 3206 | 3221 | 114 |
| 561012 | 104 | 119 | TTGTCTTGATCAATTC | Deoxy, MOE, and cEt | 64 | 3208 | 3223 | 3621 |
| 561013 | 106 | 121 | AATTGTCTTGATCAAT | Deoxy, MOE, and cEt | 21 | 3210 | 3225 | 3622 |
| 561014 | 108 | 123 | TGAATTGTCTTGATCA | Deoxy, MOE, and cEt | 66 | 3212 | 3227 | 3623 |
| 561015 | 110 | 125 | GATGAATTGTCTTGAT | Deoxy, MOE, and cEt | 51 | 3214 | 3229 | 3624 |
| 561016 | 112 | 127 | ATGATGAATTGTCTTG | Deoxy, MOE, and cEt | 71 | 3216 | 3231 | 3625 |
| 561017 | 115 | 130 | CAAATGATGAATTGTC | Deoxy, MOE, and cEt | 36 | 3219 | 3234 | 3626 |
| 561018 | 117 | 132 | ATCAAATGATGAATTG | Deoxy, MOE, and cEt | 27 | 3221 | 3236 | 3627 |
| 561019 | 125 | 140 | GATAGAGAATCAAATG | Deoxy, MOE, and cEt | 11 | 3229 | 3244 | 3628 |
| 561020 | 129 | 144 | TGGAGATAGAGAATCA | Deoxy, MOE, and cEt | 73 | 3233 | 3248 | 3629 |
| 561021 | 131 | 146 | TCTGGAGATAGAGAAT | Deoxy, MOE, and cEt | 51 | 3235 | 3250 | 3630 |
| 561022 | 135 | 150 | TGGCTCTGGAGATAGA | Deoxy, MOE, and cEt | 76 | 3239 | 3254 | 115 |
| 561023 | 137 | 152 | TTTGGCTCTGGAGATA | Deoxy, MOE, and cEt | 73 | 3241 | 3256 | 3631 |
| 561024 | 139 | 154 | ATTTTGGCTCTGGAGA | Deoxy, MOE, and cEt | 61 | 3243 | 3258 | 3632 |
| 561025 | 141 | 156 | TGATTTTGGCTCTGGA | Deoxy, MOE, and cEt | 83 | 3245 | 3260 | 116 |
| 561026 | 143 | 158 | CTTGATTTTGGCTCTG | Deoxy, MOE, and cEt | 83 | 3247 | 3262 | 117 |
| 561027 | 145 | 160 | ATCTTGATTTTGGCTC | Deoxy, MOE, and cEt | 67 | 3249 | 3264 | 3633 |
| 559277 | 147 | 162 | AAATCTTGATTTTGGC | Deoxy, MOE, and cEt | 75 | 3251 | 3266 | 110 |
| 561028 | 149 | 164 | GCAAATCTTGATTTTG | Deoxy, MOE, and cEt | 53 | 3253 | 3268 | 3634 |
| 561029 | 151 | 166 | TAGCAAATCTTGATTT | Deoxy, MOE, and cEt | 27 | 3255 | 3270 | 3635 |
| 561030 | 153 | 168 | CATAGCAAATCTTGAT | Deoxy, MOE, and cEt | 63 | 3257 | 3272 | 3636 |
| 561031 | 155 | 170 | AACATAGCAAATCTTG | Deoxy, MOE, and cEt | 56 | 3259 | 3274 | 3637 |
| 561032 | 157 | 172 | CTAACATAGCAAATCT | Deoxy, MOE, and cEt | 67 | 3261 | 3276 | 3638 |
| 561033 | 159 | 174 | GTCTAACATAGCAAAT | Deoxy, MOE, and cEt | 51 | 3263 | 3278 | 3639 |
| 561034 | 174 | 189 | TAAAATTTTTACATCG | Deoxy, MOE, and cEt | 4 | 3278 | 3293 | 3640 |
| 561035 | 177 | 192 | GGCTAAAATTTTTACA | Deoxy, MOE, and cEt | 0 | 3281 | 3296 | 3641 |
| 561036 | 182 | 197 | CCATTGGCTAAAATTT | Deoxy, MOE, and cEt | 3 | 3286 | 3301 | 3642 |
| 561037 | 184 | 199 | GGCCATTGGCTAAAAT | Deoxy, MOE, and cEt | 16 | 3288 | 3303 | 3643 |
| 561038 | 186 | 201 | GAGGCCATTGGCTAAA | Deoxy, MOE, and cEt | 42 | 3290 | 3305 | 3644 |
| 561039 | 188 | 203 | AGGAGGCCATTGGCTA | Deoxy, MOE, and cEt | 61 | 3292 | 3307 | 3645 |
| 561040 | 190 | 205 | GAAGGAGGCCATTGGC | Deoxy, MOE, and cEt | 35 | 3294 | 3309 | 3646 |
| 561041 | 192 | 207 | CTGAAGGAGGCCATTG | Deoxy, MOE, and cEt | 37 | 3296 | 3311 | 3647 |

TABLE 26-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561042 | 194 | 209 | AACTGAAGGAGGCCAT | Deoxy, MOE, and cEt | 22 | 3298 | 3313 | 3648 |
| 561043 | 196 | 211 | CCAACTGAAGGAGGCC | Deoxy, MOE, and cEt | 33 | 3300 | 3315 | 3649 |
| 561044 | 198 | 213 | TCCCAACTGAAGGAGG | Deoxy, MOE, and cEt | 19 | 3302 | 3317 | 3650 |
| 561045 | 200 | 215 | TGTCCCAACTGAAGGA | Deoxy, MOE, and cEt | 33 | 3304 | 3319 | 3651 |
| 561046 | 202 | 217 | CATGTCCCAACTGAAG | Deoxy, MOE, and cEt | 19 | 3306 | 3321 | 3652 |
| 561047 | 204 | 219 | ACCATGTCCCAACTGA | Deoxy, MOE, and cEt | 19 | 3308 | 3323 | 3653 |
| 561048 | 206 | 221 | AGACCATGTCCCAACT | Deoxy, MOE, and cEt | 19 | 3310 | 3325 | 3654 |
| 561049 | 208 | 223 | TAAGACCATGTCCCAA | Deoxy, MOE, and cEt | 0 | 3312 | 3327 | 3655 |
| 561050 | 210 | 225 | TTTAAGACCATGTCCC | Deoxy, MOE, and cEt | 5 | 3314 | 3329 | 3656 |
| 561051 | 212 | 227 | TCTTTAAGACCATGTC | Deoxy, MOE, and cEt | 10 | 3316 | 3331 | 3657 |
| 561052 | 214 | 229 | AGTCTTTAAGACCATG | Deoxy, MOE, and cEt | 10 | 3318 | 3333 | 3658 |
| 561053 | 216 | 231 | AAAGTCTTTAAGACCA | Deoxy, MOE, and cEt | 29 | 3320 | 3335 | 3659 |
| 561054 | 218 | 233 | ACAAAGTCTTTAAGAC | Deoxy, MOE, and cEt | 19 | 3322 | 3337 | 3660 |
| 561055 | 220 | 235 | GGACAAAGTCTTTAAG | Deoxy, MOE, and cEt | 21 | 3324 | 3339 | 3661 |
| 561056 | 222 | 237 | ATGGACAAAGTCTTTA | Deoxy, MOE, and cEt | 12 | 3326 | 3341 | 3662 |
| 561057 | 224 | 239 | TTATGGACAAAGTCTT | Deoxy, MOE, and cEt | 10 | 3328 | 3343 | 3663 |
| 561058 | 226 | 241 | TCTTATGGACAAAGTC | Deoxy, MOE, and cEt | 9 | 3330 | 3345 | 3664 |
| 561059 | 228 | 243 | CGTCTTATGGACAAAG | Deoxy, MOE, and cEt | 0 | 3332 | 3347 | 3665 |
| 561060 | 242 | 257 | TTAATTTGGCCCTTCG | Deoxy, MOE, and cEt | 28 | 3346 | 3361 | 3666 |
| 561061 | 244 | 259 | CATTAATTTGGCCCTT | Deoxy, MOE, and cEt | 13 | 3348 | 3363 | 3667 |
| 561062 | 246 | 261 | GTCATTAATTTGGCCC | Deoxy, MOE, and cEt | 63 | 3350 | 3365 | 3668 |
| 561063 | 248 | 263 | ATGTCATTAATTTGGC | Deoxy, MOE, and cEt | 37 | 3352 | 3367 | 3669 |
| 561064 | 267 | 282 | TATGTTGAGTTTTTGA | Deoxy, MOE, and cEt | 16 | 3371 | 3386 | 3670 |
| 561065 | 272 | 287 | TCAAATATGTTGAGTT | Deoxy, MOE, and cEt | 21 | 3376 | 3391 | 3671 |
| 561066 | 274 | 289 | GATCAAATATGTTGAG | Deoxy, MOE, and cEt | 36 | 3378 | 3393 | 3672 |
| 560990 | 709 | 724 | TTCTTGGTGCTCTTGG | Deoxy, MOE, and cEt | 73 | 6722 | 6737 | 111 |
| 337487 | 804 | 823 | CACTTGTATGTTCACCTCTG | 5-10-5 MOE | 76 | 7389 | 7408 | 28 |
| 561604 | 1850 | 1865 | GTACAATTACCAGTCC | Deoxy, MOE, and cEt | 59 | 10822 | 10837 | 3673 |
| 561605 | 1852 | 1867 | CTGTACAATTACCAGT | Deoxy, MOE, and cEt | 54 | 10824 | 10839 | 3674 |
| 561606 | 1854 | 1869 | AACTGTACAATTACCA | Deoxy, MOE, and cEt | 57 | 10826 | 10841 | 3675 |
| 561607 | 1856 | 1871 | AGAACTGTACAATTAC | Deoxy, MOE, and cEt | 36 | 10828 | 10843 | 3676 |
| 561608 | 1858 | 1873 | TAAGAACTGTACAATT | Deoxy, MOE, and cEt | 29 | 10830 | 10845 | 3677 |
| 561609 | 1862 | 1877 | CATTTAAGAACTGTAC | Deoxy, MOE, and cEt | 24 | 10834 | 10849 | 3678 |
| 561610 | 1870 | 1885 | TACTACAACATTTAAG | Deoxy, MOE, and cEt | 1 | 10842 | 10857 | 3679 |
| 561611 | 1874 | 1889 | TTAATACTACAACATT | Deoxy, MOE, and cEt | 0 | 10846 | 10861 | 3680 |
| 561612 | 1880 | 1895 | TTGAAATTAATACTAC | Deoxy, MOE, and cEt | 6 | 10852 | 10867 | 3681 |

TABLE 26-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561613 | 1883 | 1898 | GTTTTGAAATTAATAC | Deoxy, MOE, and cEt | 34 | 10855 | 10870 | 3682 |
| 561614 | 1892 | 1907 | CGATTTTTAGTTTTGA | Deoxy, MOE, and cEt | 22 | 10864 | 10879 | 3683 |
| 561615 | 1894 | 1909 | GACGATTTTTAGTTTT | Deoxy, MOE, and cEt | 29 | 10866 | 10881 | 3684 |
| 561616 | 1896 | 1911 | CTGACGATTTTTAGTT | Deoxy, MOE, and cEt | 50 | 10868 | 10883 | 3685 |
| 561617 | 1898 | 1913 | TGCTGACGATTTTTAG | Deoxy, MOE, and cEt | 54 | 10870 | 10885 | 3686 |
| 561618 | 1900 | 1915 | TGTGCTGACGATTTTT | Deoxy, MOE, and cEt | 70 | 10872 | 10887 | 3687 |
| 561619 | 1902 | 1917 | TCTGTGCTGACGATTT | Deoxy, MOE, and cEt | 69 | 10874 | 10889 | 3688 |
| 561620 | 1904 | 1919 | ACTCTGTGCTGACGAT | Deoxy, MOE, and cEt | 78 | 10876 | 10891 | 135 |
| 561621 | 1906 | 1921 | ATACTCTGTGCTGACG | Deoxy, MOE, and cEt | 87 | 10878 | 10893 | 134 |
| 561622 | 1908 | 1923 | ACATACTCTGTGCTGA | Deoxy, MOE, and cEt | 80 | 10880 | 10895 | 136 |
| 561623 | 1911 | 1926 | TACACATACTCTGTGC | Deoxy, MOE, and cEt | 61 | 10883 | 10898 | 3689 |
| 561624 | 1913 | 1928 | TTTACACATACTCTGT | Deoxy, MOE, and cEt | 68 | 10885 | 10900 | 3690 |
| 561625 | 1917 | 1932 | GATTTTTACACATACT | Deoxy, MOE, and cEt | 17 | 10889 | 10904 | 3691 |
| 561626 | 1946 | 1961 | GAAGCATCAGTTTAAA | Deoxy, MOE, and cEt | 27 | 10918 | 10933 | 3692 |
| 561627 | 1948 | 1963 | ATGAAGCATCAGTTTA | Deoxy, MOE, and cEt | 5 | 10920 | 10935 | 3693 |
| 561628 | 1956 | 1971 | GTAGCAAAATGAAGCA | Deoxy, MOE, and cEt | 73 | 10928 | 10943 | 137 |
| 561629 | 1958 | 1973 | TTGTAGCAAAATGAAG | Deoxy, MOE, and cEt | 42 | 10930 | 10945 | 3694 |
| 561630 | 1976 | 1991 | CATTTACTCCAAATTA | Deoxy, MOE, and cEt | 43 | 10948 | 10963 | 3695 |
| 561631 | 1981 | 1996 | TCAAACATTTACTCCA | Deoxy, MOE, and cEt | 82 | 10953 | 10968 | 138 |
| 561632 | 2006 | 2021 | CATTAGGTTTCATAAA | Deoxy, MOE, and cEt | 19 | 10978 | 10993 | 3696 |
| 561633 | 2008 | 2023 | TTCATTAGGTTTCATA | Deoxy, MOE, and cEt | 15 | 10980 | 10995 | 3697 |
| 561634 | 2010 | 2025 | GCTTCATTAGGTTTCA | Deoxy, MOE, and cEt | 57 | 10982 | 10997 | 3698 |
| 561635 | 2012 | 2027 | CTGCTTCATTAGGTTT | Deoxy, MOE, and cEt | 0 | 10984 | 10999 | 3699 |
| 561636 | 2014 | 2029 | TTCTGCTTCATTAGGT | Deoxy, MOE, and cEt | 65 | 10986 | 11001 | 3700 |
| 561637 | 2016 | 2031 | AATTCTGCTTCATTAG | Deoxy, MOE, and cEt | 48 | 10988 | 11003 | 3701 |
| 561638 | 2024 | 2039 | CAGTATTTAATTCTGC | Deoxy, MOE, and cEt | 38 | 10996 | 11011 | 3702 |
| 561639 | 2039 | 2054 | GAACTTATTTAATAC | Deoxy, MOE, and cEt | 29 | 11011 | 11026 | 3703 |
| 561640 | 2041 | 2056 | GCGAACTTATTTTAAT | Deoxy, MOE, and cEt | 38 | 11013 | 11028 | 3704 |
| 561641 | 2043 | 2058 | CAGCGAACTTATTTTA | Deoxy, MOE, and cEt | 46 | 11015 | 11030 | 3705 |
| 561642 | 2045 | 2060 | GACAGCGAACTTATTT | Deoxy, MOE, and cEt | 64 | 11017 | 11032 | 3706 |
| 561643 | 2047 | 2062 | AAGACAGCGAACTTAT | Deoxy, MOE, and cEt | 19 | 11019 | 11034 | 3707 |
| 561644 | 2049 | 2064 | TAAAGACAGCGAACTT | Deoxy, MOE, and cEt | 76 | 11021 | 11036 | 139 |
| 561645 | 2051 | 2066 | TTTAAAGACAGCGAAC | Deoxy, MOE, and cEt | 49 | 11023 | 11038 | 3708 |
| 561646 | 2053 | 2068 | TGTTTAAAGACAGCGA | Deoxy, MOE, and cEt | 81 | 11025 | 11040 | 140 |
| 561647 | 2065 | 2080 | GTCATCTCCATTTGTT | Deoxy, MOE, and cEt | 60 | 11037 | 11052 | 3709 |
| 561648 | 2067 | 2082 | TAGTCATCTCCATTTG | Deoxy, MOE, and cEt | 69 | 11039 | 11054 | 3710 |

TABLE 26-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561649 | 2069 | 2084 | AGTAGTCATCTCCATT | Deoxy, MOE, and cEt | 82 | 11041 | 11056 | 141 |
| 561650 | 2071 | 2086 | TTAGTAGTCATCTCCA | Deoxy, MOE, and cEt | 79 | 11043 | 11058 | 142 |
| 561651 | 2073 | 2088 | ACTTAGTAGTCATCTC | Deoxy, MOE, and cEt | 66 | 11045 | 11060 | 3711 |
| 561652 | 2075 | 2090 | TGACTTAGTAGTCATC | Deoxy, MOE, and cEt | 62 | 11047 | 11062 | 3712 |
| 561653 | 2077 | 2092 | TGTGACTTAGTAGTCA | Deoxy, MOE, and cEt | 52 | 11049 | 11064 | 3713 |
| 561654 | 2079 | 2094 | AATGTGACTTAGTAGT | Deoxy, MOE, and cEt | 44 | 11051 | 11066 | 3714 |
| 561655 | 2081 | 2096 | TCAATGTGACTTAGTA | Deoxy, MOE, and cEt | 65 | 11053 | 11068 | 3715 |
| 561656 | 2083 | 2098 | AGTCAATGTGACTTAG | Deoxy, MOE, and cEt | 70 | 11055 | 11070 | 3716 |
| 561657 | 2085 | 2100 | AAAGTCAATGTGACTT | Deoxy, MOE, and cEt | 2 | 11057 | 11072 | 3717 |
| 561658 | 2087 | 2102 | TTAAAGTCAATGTGAC | Deoxy, MOE, and cEt | 15 | 11059 | 11074 | 3718 |
| 561659 | 2089 | 2104 | TGTTAAAGTCAATGTG | Deoxy, MOE, and cEt | 27 | 11061 | 11076 | 3719 |
| 561660 | 2091 | 2106 | CATGTTAAAGTCAATG | Deoxy, MOE, and cEt | 51 | 11063 | 11078 | 3720 |
| 561661 | 2093 | 2108 | CTCATGTTAAAGTCAA | Deoxy, MOE, and cEt | 53 | 11065 | 11080 | 3721 |
| 561662 | 2095 | 2110 | ACCTCATGTTAAAGTC | Deoxy, MOE, and cEt | 55 | 11067 | 11082 | 3722 |
| 561663 | 2097 | 2112 | ATACCTCATGTTAAAG | Deoxy, MOE, and cEt | 25 | 11069 | 11084 | 3723 |
| 561664 | 2099 | 2114 | TGATACCTCATGTTAA | Deoxy, MOE, and cEt | 0 | 11071 | 11086 | 3724 |
| 561665 | 2101 | 2116 | AGTGATACCTCATGTT | Deoxy, MOE, and cEt | 38 | 11073 | 11088 | 3725 |
| 561666 | 2103 | 2118 | ATAGTGATACCTCATG | Deoxy, MOE, and cEt | 61 | 11075 | 11090 | 3726 |
| 561667 | 2105 | 2120 | GTATAGTGATACCTCA | Deoxy, MOE, and cEt | 63 | 11077 | 11092 | 3727 |
| 561668 | 2107 | 2122 | AGGTATAGTGATACCT | Deoxy, MOE, and cEt | 27 | 11079 | 11094 | 3728 |
| 561669 | 2109 | 2124 | TAAGGTATAGTGATAC | Deoxy, MOE, and cEt | 34 | 11081 | 11096 | 3729 |
| 561670 | 2111 | 2126 | AATAAGGTATAGTGAT | Deoxy, MOE, and cEt | 22 | 11083 | 11098 | 3730 |

TABLE 27

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 562220 | N/A | N/A | GTAAACTTATTGATAA | Deoxy, MOE, and cEt | 0 | 7670 | 7685 | 3731 |
| 562221 | N/A | N/A | GGCATAGTAAACTTAT | Deoxy, MOE, and cEt | 22 | 7676 | 7691 | 3732 |
| 562222 | N/A | N/A | AATTTTGGCATAGTAA | Deoxy, MOE, and cEt | 0 | 7682 | 7697 | 3733 |
| 562223 | N/A | N/A | GGCAATTAATGAATTT | Deoxy, MOE, and cEt | 15 | 7693 | 7708 | 3734 |
| 562224 | N/A | N/A | GTGAAAGGCAATTAAT | Deoxy, MOE, and cEt | 7 | 7699 | 7714 | 3735 |
| 562225 | N/A | N/A | AGTTAAGTGAAAGGCA | Deoxy, MOE, and cEt | 0 | 7705 | 7720 | 3736 |
| 562226 | N/A | N/A | CCCAAAAGTTAAGTGA | Deoxy, MOE, and cEt | 27 | 7711 | 7726 | 3737 |
| 562227 | N/A | N/A | TATGGTCCCAAAAGTT | Deoxy, MOE, and cEt | 35 | 7717 | 7732 | 3738 |

TABLE 27-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 562228 | N/A | N/A | ATTTATTATGGTCCCA | Deoxy, MOE, and cEt | 67 | 7723 | 7738 | 3739 |
| 562229 | N/A | N/A | GTTATGGCAATACATT | Deoxy, MOE, and cEt | 37 | 7744 | 7759 | 3740 |
| 562230 | N/A | N/A | ATTAATGTTATGGCAA | Deoxy, MOE, and cEt | 33 | 7750 | 7765 | 3741 |
| 562231 | N/A | N/A | GTAGTTTATTAATGTT | Deoxy, MOE, and cEt | 15 | 7757 | 7772 | 3742 |
| 562232 | N/A | N/A | TGTAAGGTAGTTTATT | Deoxy, MOE, and cEt | 23 | 7763 | 7778 | 3743 |
| 562233 | N/A | N/A | TGGTTTTGTAAGGTAG | Deoxy, MOE, and cEt | 43 | 7769 | 7784 | 3744 |
| 562234 | N/A | N/A | AATTGGTGGTTTTGTA | Deoxy, MOE, and cEt | 18 | 7775 | 7790 | 3745 |
| 562235 | N/A | N/A | GATTTTAATTGGTGGT | Deoxy, MOE, and cEt | 21 | 7781 | 7796 | 3746 |
| 562236 | N/A | N/A | GATGTAAATAACACTT | Deoxy, MOE, and cEt | 9 | 7809 | 7824 | 3747 |
| 562237 | N/A | N/A | TTGACAGATGTAAATA | Deoxy, MOE, and cEt | 11 | 7815 | 7830 | 3748 |
| 562238 | N/A | N/A | TTTATGTTGACAGATG | Deoxy, MOE, and cEt | 20 | 7821 | 7836 | 3749 |
| 562239 | N/A | N/A | AGTAGATTTATGTTGA | Deoxy, MOE, and cEt | 9 | 7827 | 7842 | 3750 |
| 562240 | N/A | N/A | CCTGAATATAATGAAT | Deoxy, MOE, and cEt | 29 | 7859 | 7874 | 3751 |
| 562241 | N/A | N/A | GGACTACCTGAATATA | Deoxy, MOE, and cEt | 17 | 7865 | 7880 | 3752 |
| 562242 | N/A | N/A | ACCATCAAGCCTCCCA | Deoxy, MOE, and cEt | 45 | 7956 | 7971 | 3753 |
| 562243 | N/A | N/A | CCCCTTACCATCAAGC | Deoxy, MOE, and cEt | 31 | 7962 | 7977 | 3754 |
| 562244 | N/A | N/A | TGTAGTCCCCTTACCA | Deoxy, MOE, and cEt | 16 | 7968 | 7983 | 3755 |
| 562245 | N/A | N/A | ATTGAATGTAGTCCCC | Deoxy, MOE, and cEt | 19 | 7974 | 7989 | 3756 |
| 562246 | N/A | N/A | GATTAGCAAGTGAATG | Deoxy, MOE, and cEt | 6 | 7994 | 8009 | 3757 |
| 562247 | N/A | N/A | TTTGTAGATTAGCAAG | Deoxy, MOE, and cEt | 24 | 8000 | 8015 | 3758 |
| 562248 | N/A | N/A | AAGAGGTTCTCAGTAA | Deoxy, MOE, and cEt | 28 | 8019 | 8034 | 3759 |
| 562249 | N/A | N/A | GTCCATAAGAGGTTCT | Deoxy, MOE, and cEt | 34 | 8025 | 8040 | 3760 |
| 562250 | N/A | N/A | TACCTGGTCCATAAGA | Deoxy, MOE, and cEt | 10 | 8031 | 8046 | 3761 |
| 562251 | N/A | N/A | TCCTAATACCTGGTCC | Deoxy, MOE, and cEt | 32 | 8037 | 8052 | 3762 |
| 562252 | N/A | N/A | TACTTTTCCTAATACC | Deoxy, MOE, and cEt | 20 | 8043 | 8058 | 3763 |
| 562253 | N/A | N/A | CGTTACTACTTTTCCT | Deoxy, MOE, and cEt | 29 | 8049 | 8064 | 3764 |
| 562254 | N/A | N/A | CTGAGACTGCTTCTCG | Deoxy, MOE, and cEt | 36 | 8067 | 8082 | 3765 |
| 562255 | N/A | N/A | TGAAGGCTGAGACTGC | Deoxy, MOE, and cEt | 40 | 8073 | 8088 | 3766 |
| 562256 | N/A | N/A | TAAATTATATGAAGGC | Deoxy, MOE, and cEt | 9 | 8082 | 8097 | 3767 |
| 562257 | N/A | N/A | GTAATTGTTTGATAAT | Deoxy, MOE, and cEt | 0 | 8097 | 8112 | 3768 |
| 562258 | N/A | N/A | TACTAACAAATGTGTA | Deoxy, MOE, and cEt | 0 | 8110 | 8125 | 3769 |
| 562259 | N/A | N/A | GTAATTTACTAACAAA | Deoxy, MOE, and cEt | 0 | 8116 | 8131 | 3770 |
| 562260 | N/A | N/A | ATAAGTGTAATTTACT | Deoxy, MOE, and cEt | 0 | 8122 | 8137 | 3771 |
| 562261 | N/A | N/A | GTTGTAATAAGTGTAA | Deoxy, MOE, and cEt | 0 | 8128 | 8143 | 3772 |
| 562262 | N/A | N/A | GTGATAAATATAATTC | Deoxy, MOE, and cEt | 0 | 8155 | 8170 | 3773 |
| 562263 | N/A | N/A | CATGTAATTGTGATAA | Deoxy, MOE, and cEt | 20 | 8164 | 8179 | 3774 |

TABLE 27-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 562264 | N/A | N/A | GTATATTTAAGAACAG | Deoxy, MOE, and cEt | 13 | 8181 | 8196 | 3775 |
| 562265 | N/A | N/A | TTGTGATAAGTATATT | Deoxy, MOE, and cEt | 3 | 8190 | 8205 | 3776 |
| 562266 | N/A | N/A | TGGAATTAAATTGTGA | Deoxy, MOE, and cEt | 0 | 8200 | 8215 | 3777 |
| 562267 | N/A | N/A | AAGCCGTGGAATTAAA | Deoxy, MOE, and cEt | 10 | 8206 | 8221 | 3778 |
| 562268 | N/A | N/A | CATTGTAAGCCGTGGA | Deoxy, MOE, and cEt | 54 | 8212 | 8227 | 3779 |
| 562269 | N/A | N/A | TATGATCATTGTAAGC | Deoxy, MOE, and cEt | 0 | 8218 | 8233 | 3780 |
| 562270 | N/A | N/A | TATAGTTATGATCATT | Deoxy, MOE, and cEt | 0 | 8224 | 8239 | 3781 |
| 562271 | N/A | N/A | GACATAACATTTAATC | Deoxy, MOE, and cEt | 21 | 8258 | 8273 | 3782 |
| 562272 | N/A | N/A | ACTTATGACATAACAT | Deoxy, MOE, and cEt | 14 | 8264 | 8279 | 3783 |
| 562273 | N/A | N/A | GTTACTACTTATGACA | Deoxy, MOE, and cEt | 30 | 8270 | 8285 | 3784 |
| 562274 | N/A | N/A | GTAACAGTTACTACTT | Deoxy, MOE, and cEt | 24 | 8276 | 8291 | 3785 |
| 562275 | N/A | N/A | GCTTATTTGTAACAGT | Deoxy, MOE, and cEt | 17 | 8284 | 8299 | 3786 |
| 562276 | N/A | N/A | TTCACAGCTTATTTGT | Deoxy, MOE, and cEt | 20 | 8290 | 8305 | 3787 |
| 562277 | N/A | N/A | GTTCTTTTCACAGCTT | Deoxy, MOE, and cEt | 46 | 8296 | 8311 | 3788 |
| 562278 | N/A | N/A | GGAGTGGTTCTTTTCA | Deoxy, MOE, and cEt | 35 | 8302 | 8317 | 3789 |
| 562279 | N/A | N/A | ATGCTAGGAGTGGTTC | Deoxy, MOE, and cEt | 29 | 8308 | 8323 | 3790 |
| 562280 | N/A | N/A | TGACTAATGCTAGGAG | Deoxy, MOE, and cEt | 4 | 8314 | 8329 | 3791 |
| 562281 | N/A | N/A | ATAGAGTGACTAATGC | Deoxy, MOE, and cEt | 23 | 8320 | 8335 | 3792 |
| 562282 | N/A | N/A | GAGAGAATAGAGTGAC | Deoxy, MOE, and cEt | 15 | 8326 | 8341 | 3793 |
| 562284 | N/A | N/A | ATTGATATGTAAAACG | Deoxy, MOE, and cEt | 7 | 8347 | 8362 | 3794 |
| 562285 | N/A | N/A | CAATTAATTGATATGT | Deoxy, MOE, and cEt | 14 | 8353 | 8368 | 3795 |
| 562286 | N/A | N/A | CCTTTTAACTTCCAAT | Deoxy, MOE, and cEt | 40 | 8365 | 8380 | 3796 |
| 562287 | N/A | N/A | CCTGGTCCTTTTAACT | Deoxy, MOE, and cEt | 29 | 8371 | 8386 | 3797 |
| 562288 | N/A | N/A | GAGTTTCCTGGTCCTT | Deoxy, MOE, and cEt | 49 | 8377 | 8392 | 3798 |
| 562289 | N/A | N/A | ATGTCTGAGTTTCCTG | Deoxy, MOE, and cEt | 16 | 8383 | 8398 | 3799 |
| 562290 | N/A | N/A | TACTGTATGTCTGAGT | Deoxy, MOE, and cEt | 33 | 8389 | 8404 | 3800 |
| 562291 | N/A | N/A | CCATACATTCTATATA | Deoxy, MOE, and cEt | 10 | 8437 | 8452 | 3801 |
| 562292 | N/A | N/A | TATAAGCCATACATTC | Deoxy, MOE, and cEt | 24 | 8443 | 8458 | 3802 |
| 562293 | N/A | N/A | ATTCATTATAAGCCAT | Deoxy, MOE, and cEt | 38 | 8449 | 8464 | 3803 |
| 562295 | N/A | N/A | CATTGAGTTAACTAAT | Deoxy, MOE, and cEt | 7 | 8463 | 8478 | 3804 |
| 562296 | N/A | N/A | AATTTGCATTGAGTTA | Deoxy, MOE, and cEt | 18 | 8469 | 8484 | 3805 |
| 561144 | 525 | 540 | TGAAGTTACTTCTGGG | Deoxy, MOE, and cEt | 39 | 3629 | 3644 | 3806 |
| 561145 | 527 | 542 | AGTGAAGTTACTTCTG | Deoxy, MOE, and cEt | 51 | 3631 | 3646 | 3807 |
| 561146 | 529 | 544 | TAAGTGAAGTTACTTC | Deoxy, MOE, and cEt | 40 | 3633 | 3648 | 3808 |
| 561147 | 533 | 548 | GTTTAAGTGAAGTTA | Deoxy, MOE, and cEt | 29 | N/A | N/A | 3809 |
| 561148 | 535 | 550 | AAGTTTTAAGTGAAGT | Deoxy, MOE, and cEt | 19 | N/A | N/A | 3810 |

TABLE 27-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561149 | 547 | 562 | GTTTTTCTACAAAAGT | Deoxy, MOE, and cEt | 38 | 4285 | 4300 | 3811 |
| 561150 | 560 | 575 | ATGCTATTATCTTGTT | Deoxy, MOE, and cEt | 30 | 4298 | 4313 | 3812 |
| 561151 | 562 | 577 | TGATGCTATTATCTTG | Deoxy, MOE, and cEt | 36 | 4300 | 4315 | 3813 |
| 561152 | 564 | 579 | TTTGATGCTATTATCT | Deoxy, MOE, and cEt | 23 | 4302 | 4317 | 3814 |
| 561153 | 567 | 582 | GTCTTTGATGCTATTA | Deoxy, MOE, and cEt | 51 | 4305 | 4320 | 3815 |
| 561154 | 569 | 584 | AGGTCTTTGATGCTAT | Deoxy, MOE, and cEt | 60 | 4307 | 4322 | 3816 |
| 561155 | 571 | 586 | GAAGGTCTTTGATGCT | Deoxy, MOE, and cEt | 61 | 4309 | 4324 | 3817 |
| 561156 | 573 | 588 | GAGAAGGTCTTTGATG | Deoxy, MOE, and cEt | 30 | 4311 | 4326 | 3818 |
| 561157 | 575 | 590 | TGGAGAAGGTCTTTGA | Deoxy, MOE, and cEt | 40 | 4313 | 4328 | 3819 |
| 561158 | 577 | 592 | TCTGGAGAAGGTCTTT | Deoxy, MOE, and cEt | 46 | 4315 | 4330 | 3820 |
| 561159 | 579 | 594 | GGTCTGGAGAAGGTCT | Deoxy, MOE, and cEt | 57 | 4317 | 4332 | 3821 |
| 561160 | 581 | 596 | ACGGTCTGGAGAAGGT | Deoxy, MOE, and cEt | 57 | 4319 | 4334 | 3822 |
| 561161 | 583 | 598 | CCACGGTCTGGAGAAG | Deoxy, MOE, and cEt | 56 | 4321 | 4336 | 3823 |
| 561162 | 585 | 600 | TTCCACGGTCTGGAGA | Deoxy, MOE, and cEt | 50 | 4323 | 4338 | 3824 |
| 561163 | 587 | 602 | TCTTCCACGGTCTGGA | Deoxy, MOE, and cEt | 77 | 4325 | 4340 | 3825 |
| 561164 | 589 | 604 | GGTCTTCCACGGTCTG | Deoxy, MOE, and cEt | 89 | 4327 | 4342 | 3826 |
| 561165 | 591 | 606 | TTGGTCTTCCACGGTC | Deoxy, MOE, and cEt | 79 | 4329 | 4344 | 3827 |
| 561166 | 593 | 608 | TATTGGTCTTCCACGG | Deoxy, MOE, and cEt | 39 | 4331 | 4346 | 3828 |
| 561167 | 595 | 610 | TATATTGGTCTTCCAC | Deoxy, MOE, and cEt | 22 | 4333 | 4348 | 3829 |
| 561168 | 597 | 612 | TTTATATTGGTCTTCC | Deoxy, MOE, and cEt | 43 | 4335 | 4350 | 3830 |
| 561169 | 599 | 614 | TGTTTATATTGGTCTT | Deoxy, MOE, and cEt | 50 | 4337 | 4352 | 3831 |
| 561170 | 601 | 616 | ATTGTTTATATTGGTC | Deoxy, MOE, and cEt | 27 | 4339 | 4354 | 3832 |
| 561171 | 603 | 618 | TAATTGTTTATATTGG | Deoxy, MOE, and cEt | 21 | 4341 | 4356 | 3833 |
| 561172 | 607 | 622 | GGTTAATTGTTTATA | Deoxy, MOE, and cEt | 22 | 4345 | 4360 | 3834 |
| 561173 | 610 | 625 | GTTGGTTTAATTGTTT | Deoxy, MOE, and cEt | 33 | 4348 | 4363 | 3835 |
| 561174 | 612 | 627 | CTGTTGGTTTAATTGT | Deoxy, MOE, and cEt | 13 | 4350 | 4365 | 3836 |
| 561175 | 614 | 629 | TGCTGTTGGTTTAATT | Deoxy, MOE, and cEt | 26 | 4352 | 4367 | 3837 |
| 561176 | 616 | 631 | TATGCTGTTGGTTTAA | Deoxy, MOE, and cEt | 40 | 4354 | 4369 | 3838 |
| 561177 | 618 | 633 | ACTATGCTGTTGGTTT | Deoxy, MOE, and cEt | 68 | 4356 | 4371 | 3839 |
| 561178 | 620 | 635 | TGACTATGCTGTTGGT | Deoxy, MOE, and cEt | 64 | 4358 | 4373 | 3840 |
| 561179 | 622 | 637 | TTTGACTATGCTGTTG | Deoxy, MOE, and cEt | 42 | 4360 | 4375 | 3841 |
| 561180 | 624 | 639 | TATTTGACTATGCTGT | Deoxy, MOE, and cEt | 16 | 4362 | 4377 | 3842 |
| 561181 | 626 | 641 | TTTATTTGACTATGCT | Deoxy, MOE, and cEt | 17 | 4364 | 4379 | 3843 |
| 561182 | 628 | 643 | CTTTTATTTGACTATG | Deoxy, MOE, and cEt | 7 | 4366 | 4381 | 3844 |
| 561183 | 645 | 660 | GAGCTGATTTTCTATT | Deoxy, MOE, and cEt | 18 | N/A | N/A | 3845 |
| 561184 | 647 | 662 | CTGAGCTGATTTTCTA | Deoxy, MOE, and cEt | 42 | N/A | N/A | 3846 |

TABLE 27-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561185 | 649 | 664 | TTCTGAGCTGATTTTC | Deoxy, MOE, and cEt | 32 | N/A | N/A | 3847 |
| 561186 | 651 | 666 | CCTTCTGAGCTGATTT | Deoxy, MOE, and cEt | 14 | N/A | N/A | 3848 |
| 561187 | 653 | 668 | GTCCTTCTGAGCTGAT | Deoxy, MOE, and cEt | 39 | 6666 | 6681 | 3849 |
| 561188 | 655 | 670 | TAGTCCTTCTGAGCTG | Deoxy, MOE, and cEt | 7 | 6668 | 6683 | 3850 |
| 561189 | 657 | 672 | ACTAGTCCTTCTGAGC | Deoxy, MOE, and cEt | 32 | 6670 | 6685 | 3851 |
| 561190 | 659 | 674 | ATACTAGTCCTTCTGA | Deoxy, MOE, and cEt | 19 | 6672 | 6687 | 3852 |
| 561191 | 661 | 676 | GAATACTAGTCCTTCT | Deoxy, MOE, and cEt | 37 | 6674 | 6689 | 3853 |
| 561192 | 663 | 678 | TTGAATACTAGTCCTT | Deoxy, MOE, and cEt | 50 | 6676 | 6691 | 3854 |
| 561193 | 665 | 680 | TCTTGAATACTAGTCC | Deoxy, MOE, and cEt | 28 | 6678 | 6693 | 3855 |
| 561194 | 667 | 682 | GTTCTTGAATACTAGT | Deoxy, MOE, and cEt | 34 | 6680 | 6695 | 3856 |
| 561195 | 669 | 684 | GGGTTCTTGAATACTA | Deoxy, MOE, and cEt | 61 | 6682 | 6697 | 3857 |
| 561196 | 671 | 686 | GTGGGTTCTTGAATAC | Deoxy, MOE, and cEt | 21 | 6684 | 6699 | 3858 |
| 561197 | 673 | 688 | CTGTGGGTTCTTGAAT | Deoxy, MOE, and cEt | 45 | 6686 | 6701 | 3859 |
| 561198 | 675 | 690 | TTCTGTGGGTTCTTGA | Deoxy, MOE, and cEt | 0 | 6688 | 6703 | 3860 |
| 561199 | 679 | 694 | AAATTTCTGTGGGTTC | Deoxy, MOE, and cEt | 31 | 6692 | 6707 | 3861 |
| 561200 | 681 | 696 | AGAAATTTCTGTGGGT | Deoxy, MOE, and cEt | 60 | 6694 | 6709 | 3862 |
| 561201 | 684 | 699 | TAGAGAAATTTCTGTG | Deoxy, MOE, and cEt | 35 | 6697 | 6712 | 3863 |
| 561202 | 686 | 701 | GATAGAGAAATTTCTG | Deoxy, MOE, and cEt | 36 | 6699 | 6714 | 3864 |
| 561203 | 694 | 709 | GCTTGGAAGATAGAGA | Deoxy, MOE, and cEt | 39 | 6707 | 6722 | 3865 |
| 561204 | 696 | 711 | TGGCTTGGAAGATAGA | Deoxy, MOE, and cEt | 32 | 6709 | 6724 | 3866 |
| 561205 | 698 | 713 | CTTGGCTTGGAAGATA | Deoxy, MOE, and cEt | 23 | 6711 | 6726 | 3867 |
| 561206 | 700 | 715 | CTCTTGGCTTGGAAGA | Deoxy, MOE, and cEt | 21 | 6713 | 6728 | 3868 |
| 561207 | 702 | 717 | TGCTCTTGGCTTGGAA | Deoxy, MOE, and cEt | 34 | 6715 | 6730 | 3869 |
| 561208 | 704 | 719 | GGTGCTCTTGGCTTGG | Deoxy, MOE, and cEt | 71 | 6717 | 6732 | 118 |
| 561209 | 706 | 721 | TTGGTGCTCTTGGCTT | Deoxy, MOE, and cEt | 59 | 6719 | 6734 | 3870 |
| 561210 | 708 | 723 | TCTTGGTGCTCTTGGC | Deoxy, MOE, and cEt | 65 | 6721 | 6736 | 3871 |
| 560990 | 709 | 724 | TTCTTGGTGCTCTTGG | Deoxy, MOE, and cEt | 54 | 6722 | 6737 | 111 |
| 561211 | 710 | 725 | GTTCTTGGTGCTCTTG | Deoxy, MOE, and cEt | 60 | 6723 | 6738 | 3872 |
| 561212 | 712 | 727 | TAGTTCTTGGTGCTCT | Deoxy, MOE, and cEt | 53 | 6725 | 6740 | 3873 |
| 561213 | 714 | 729 | AGTAGTTCTTGGTGCT | Deoxy, MOE, and cEt | 50 | 6727 | 6742 | 3874 |
| 561214 | 716 | 731 | GGAGTAGTTCTTGGTG | Deoxy, MOE, and cEt | 31 | 6729 | 6744 | 3875 |
| 561215 | 718 | 733 | AGGGAGTAGTTCTTGG | Deoxy, MOE, and cEt | 0 | 6731 | 6746 | 3876 |
| 561216 | 720 | 735 | AAAGGGAGTAGTTCTT | Deoxy, MOE, and cEt | 25 | 6733 | 6748 | 3877 |
| 561217 | 722 | 737 | AGAAAGGGAGTAGTTC | Deoxy, MOE, and cEt | 28 | 6735 | 6750 | 3878 |
| 561218 | 724 | 739 | GAAGAAAGGGAGTAGT | Deoxy, MOE, and cEt | 10 | 6737 | 6752 | 3879 |
| 561219 | 726 | 741 | CTGAAGAAAGGGAGTA | Deoxy, MOE, and cEt | 47 | 6739 | 6754 | 3880 |

TABLE 27-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561220 | 730 | 745 | TCAACTGAAGAAAGGG | Deoxy, MOE, and cEt | 50 | 6743 | 6758 | 3881 |
| 337487 | 804 | 823 | CACTTGTATGTTCACCTCTG | 5-10-5 MOE | 52 | 7389 | 7408 | 28 |
| 561297 | 926 | 941 | TCATTGAAGTTTTGTG | Deoxy, MOE, and cEt | 28 | 7913 | 7928 | 3882 |
| 561298 | 930 | 945 | CGTTTCATTGAAGTTT | Deoxy, MOE, and cEt | 35 | 7917 | 7932 | 3883 |
| 561299 | 944 | 959 | TTGTAGTTCTCCCACG | Deoxy, MOE, and cEt | 30 | 7931 | 7946 | 3884 |
| 561300 | 946 | 961 | ATTTGTAGTTCTCCCA | Deoxy, MOE, and cEt | 32 | 7933 | 7948 | 3885 |
| 561301 | 948 | 963 | ATATTTGTAGTTCTCC | Deoxy, MOE, and cEt | 24 | 7935 | 7950 | 3886 |
| 561302 | 950 | 965 | CCATATTTGTAGTTCT | Deoxy, MOE, and cEt | 5 | 7937 | 7952 | 3887 |
| 561303 | 952 | 967 | AACCATATTTGTAGTT | Deoxy, MOE, and cEt | 3 | 7939 | 7954 | 3888 |
| 561304 | 956 | 971 | CCAAAACCATATTTGT | Deoxy, MOE, and cEt | 19 | 7943 | 7958 | 3889 |
| 561305 | 959 | 974 | CTCCCAAAACCATATT | Deoxy, MOE, and cEt | 23 | 7946 | 7961 | 3890 |
| 561306 | 961 | 976 | GCCTCCCAAAACCATA | Deoxy, MOE, and cEt | 25 | 7948 | 7963 | 3891 |
| 561307 | 963 | 978 | AAGCCTCCCAAAACCA | Deoxy, MOE, and cEt | 30 | 7950 | 7965 | 3892 |
| 561308 | 965 | 980 | TCAAGCCTCCCAAAAC | Deoxy, MOE, and cEt | 16 | 7952 | 7967 | 3893 |
| 561309 | 969 | 984 | TCCATCAAGCCTCCCA | Deoxy, MOE, and cEt | 46 | N/A | N/A | 3894 |
| 561310 | 971 | 986 | TCTCCATCAAGCCTCC | Deoxy, MOE, and cEt | 13 | N/A | N/A | 3895 |
| 561311 | 973 | 988 | ATTCTCCATCAAGCCT | Deoxy, MOE, and cEt | 16 | N/A | N/A | 3896 |
| 561312 | 975 | 990 | AAATTCTCCATCAAGC | Deoxy, MOE, and cEt | 20 | N/A | N/A | 3897 |
| 561313 | 979 | 994 | ACCAAAATTCTCCATC | Deoxy, MOE, and cEt | 18 | N/A | N/A | 3898 |
| 561314 | 981 | 996 | CAACCAAAATTCTCCA | Deoxy, MOE, and cEt | 26 | N/A | N/A | 3899 |
| 561315 | 983 | 998 | CCCAACCAAAATTCTC | Deoxy, MOE, and cEt | 38 | 9558 | 9573 | 3900 |
| 559316 | 985 | 1000 | GGCCCAACCAAAATTC | Deoxy, MOE, and cEt | 14 | 9560 | 9575 | 3901 |
| 561316 | 987 | 1002 | TAGGCCCAACCAAAAT | Deoxy, MOE, and cEt | 38 | 9562 | 9577 | 3902 |
| 561317 | 989 | 1004 | TCTAGGCCCAACCAAA | Deoxy, MOE, and cEt | 51 | 9564 | 9579 | 3903 |
| 561318 | 991 | 1006 | TCTCTAGGCCCAACCA | Deoxy, MOE, and cEt | 35 | 9566 | 9581 | 3904 |
| 561319 | 993 | 1008 | CTTCTCTAGGCCCAAC | Deoxy, MOE, and cEt | 31 | 9568 | 9583 | 3905 |
| 561320 | 995 | 1010 | ATCTTCTCTAGGCCCA | Deoxy, MOE, and cEt | 68 | 9570 | 9585 | 119 |
| 561321 | 997 | 1012 | ATATCTTCTCTAGGCC | Deoxy, MOE, and cEt | 30 | 9572 | 9587 | 3906 |
| 561322 | 999 | 1014 | GTATATCTTCTCTAGG | Deoxy, MOE, and cEt | 25 | 9574 | 9589 | 3907 |
| 561323 | 1001 | 1016 | GAGTATATCTTCTCTA | Deoxy, MOE, and cEt | 26 | 9576 | 9591 | 3908 |
| 561324 | 1003 | 1018 | TGGAGTATATCTTCTC | Deoxy, MOE, and cEt | 46 | 9578 | 9593 | 3909 |
| 561325 | 1005 | 1020 | TATGGAGTATATCTTC | Deoxy, MOE, and cEt | 20 | 9580 | 9595 | 3910 |
| 561326 | 1007 | 1022 | ACTATGGAGTATATCT | Deoxy, MOE, and cEt | 20 | 9582 | 9597 | 3911 |
| 561327 | 1009 | 1024 | TCACTATGGAGTATAT | Deoxy, MOE, and cEt | 22 | 9584 | 9599 | 3912 |
| 561328 | 1011 | 1026 | CTTCACTATGGAGTAT | Deoxy, MOE, and cEt | 33 | 9586 | 9601 | 3913 |
| 561329 | 1013 | 1028 | TGCTTCACTATGGAGT | Deoxy, MOE, and cEt | 50 | 9588 | 9603 | 3914 |

TABLE 27-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561330 | 1015 | 1030 | ATTGCTTCACTATGGA | Deoxy, MOE, and cEt | 43 | 9590 | 9605 | 3915 |
| 561331 | 1017 | 1032 | AGATTGCTTCACTATG | Deoxy, MOE, and cEt | 31 | 9592 | 9607 | 3916 |
| 561332 | 1019 | 1034 | TTAGATTGCTTCACTA | Deoxy, MOE, and cEt | 36 | 9594 | 9609 | 3917 |
| 561333 | 1021 | 1036 | AATTAGATTGCTTCAC | Deoxy, MOE, and cEt | 17 | 9596 | 9611 | 3918 |
| 561334 | 1023 | 1038 | ATAATTAGATTGCTTC | Deoxy, MOE, and cEt | 23 | 9598 | 9613 | 3919 |
| 561335 | 1025 | 1040 | ACATAATTAGATTGCT | Deoxy, MOE, and cEt | 13 | 9600 | 9615 | 3920 |
| 561336 | 1031 | 1046 | CGTAAAACATAATTAG | Deoxy, MOE, and cEt | 25 | 9606 | 9621 | 3921 |
| 561337 | 1045 | 1060 | CTTCCAACTCAATTCG | Deoxy, MOE, and cEt | 0 | 9620 | 9635 | 3922 |
| 561338 | 1047 | 1062 | GTCTTCCAACTCAATT | Deoxy, MOE, and cEt | 0 | 9622 | 9637 | 3923 |
| 561339 | 1049 | 1064 | CAGTCTTCCAACTCAA | Deoxy, MOE, and cEt | 15 | 9624 | 9639 | 3924 |
| 561340 | 1051 | 1066 | TCCAGTCTTCCAACTC | Deoxy, MOE, and cEt | 22 | 9626 | 9641 | 3925 |
| 561341 | 1053 | 1068 | TTTCCAGTCTTCCAAC | Deoxy, MOE, and cEt | 2 | 9628 | 9643 | 3926 |
| 561342 | 1056 | 1071 | GTCTTTCCAGTCTTCC | Deoxy, MOE, and cEt | 45 | 9631 | 9646 | 3927 |
| 561343 | 1059 | 1074 | GTTGTCTTTCCAGTCT | Deoxy, MOE, and cEt | 67 | 9634 | 9649 | 120 |
| 561344 | 1061 | 1076 | TTGTTGTCTTTCCAGT | Deoxy, MOE, and cEt | 43 | 9636 | 9651 | 3928 |
| 561345 | 1063 | 1078 | GTTTGTTGTCTTTCCA | Deoxy, MOE, and cEt | 57 | 9638 | 9653 | 121 |
| 561346 | 1068 | 1083 | ATAATGTTTGTTGTCT | Deoxy, MOE, and cEt | 6 | 9643 | 9658 | 3929 |
| 561347 | 1098 | 1113 | GTGATTTCCCAAGTAA | Deoxy, MOE, and cEt | 66 | 9673 | 9688 | 122 |
| 561348 | 1113 | 1128 | CGTATAGTTGGTTTCG | Deoxy, MOE, and cEt | 54 | 9688 | 9703 | 3930 |
| 561349 | 1127 | 1142 | GCAACTAGATGTAGCG | Deoxy, MOE, and cEt | 50 | 9702 | 9717 | 3931 |
| 561350 | 1129 | 1144 | TCGCAACTAGATGTAG | Deoxy, MOE, and cEt | 9 | 9704 | 9719 | 3932 |
| 561351 | 1131 | 1146 | AATCGCAACTAGATGT | Deoxy, MOE, and cEt | 9 | 9706 | 9721 | 3933 |
| 561352 | 1133 | 1148 | GTAATCGCAACTAGAT | Deoxy, MOE, and cEt | 15 | 9708 | 9723 | 3934 |
| 561353 | 1135 | 1150 | CAGTAATCGCAACTAG | Deoxy, MOE, and cEt | 41 | 9710 | 9725 | 3935 |
| 561354 | 1137 | 1152 | GCCAGTAATCGCAACT | Deoxy, MOE, and cEt | 38 | 9712 | 9727 | 3936 |
| 561355 | 1139 | 1154 | TTGCCAGTAATCGCAA | Deoxy, MOE, and cEt | 32 | 9714 | 9729 | 3937 |
| 561356 | 1141 | 1156 | CATTGCCAGTAATCGC | Deoxy, MOE, and cEt | 54 | 9716 | 9731 | 3938 |
| 561357 | 1143 | 1158 | GACATTGCCAGTAATC | Deoxy, MOE, and cEt | 20 | 9718 | 9733 | 3939 |
| 561358 | 1145 | 1160 | GGGACATTGCCAGTAA | Deoxy, MOE, and cEt | 0 | 9720 | 9735 | 3940 |
| 561359 | 1160 | 1175 | TCCGGGATTGCATTGG | Deoxy, MOE, and cEt | 43 | 9735 | 9750 | 3941 |
| 561360 | 1162 | 1177 | TTTCCGGGATTGCATT | Deoxy, MOE, and cEt | 31 | 9737 | 9752 | 3942 |
| 561361 | 1164 | 1179 | GTTTTCCGGGATTGCA | Deoxy, MOE, and cEt | 31 | 9739 | 9754 | 3943 |
| 561362 | 1166 | 1181 | TTGTTTTCCGGGATTG | Deoxy, MOE, and cEt | 36 | 9741 | 9756 | 3944 |
| 561363 | 1168 | 1183 | CTTTGTTTTCCGGGAT | Deoxy, MOE, and cEt | 22 | 9743 | 9758 | 3945 |
| 561364 | 1170 | 1185 | ATCTTTGTTTTCCGGG | Deoxy, MOE, and cEt | 13 | 9745 | 9760 | 3946 |
| 561365 | 1172 | 1187 | AAATCTTTGTTTTCCG | Deoxy, MOE, and cEt | 7 | 9747 | 9762 | 3947 |

TABLE 27-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561366 | 1177 | 1192 | ACACCAAATCTTTGTT | Deoxy, MOE, and cEt | 8 | 9752 | 9767 | 3948 |
| 561367 | 1179 | 1194 | AAACACCAAATCTTTG | Deoxy, MOE, and cEt | 11 | 9754 | 9769 | 3949 |
| 561368 | 1187 | 1202 | CAAGTAGAAAACACCA | Deoxy, MOE, and cEt | 16 | 9762 | 9777 | 3950 |
| 561369 | 1189 | 1204 | CCCAAGTAGAAAACAC | Deoxy, MOE, and cEt | 23 | 9764 | 9779 | 3951 |
| 561370 | 1191 | 1206 | ATCCCAAGTAGAAAAC | Deoxy, MOE, and cEt | 27 | 9766 | 9781 | 3952 |
| 561371 | 1193 | 1208 | TGATCCCAAGTAGAAA | Deoxy, MOE, and cEt | 25 | 9768 | 9783 | 3953 |
| 561372 | 1195 | 1210 | TGTGATCCCAAGTAGA | Deoxy, MOE, and cEt | 45 | 9770 | 9785 | 3954 |

TABLE 28

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561067 | 276 | 291 | CTGATCAAATATGTTG | Deoxy, MOE, and cEt | 54 | 3380 | 3395 | 3955 |
| 561068 | 278 | 293 | GACTGATCAAATATGT | Deoxy, MOE, and cEt | 19 | 3382 | 3397 | 3956 |
| 561069 | 280 | 295 | AAGACTGATCAAATAT | Deoxy, MOE, and cEt | 17 | 3384 | 3399 | 3957 |
| 561070 | 286 | 301 | CATAAAAGACTGATC | Deoxy, MOE, and cEt | 18 | 3390 | 3405 | 3958 |
| 561071 | 289 | 304 | GATCATAAAAGACTG | Deoxy, MOE, and cEt | 11 | 3393 | 3408 | 3959 |
| 561072 | 291 | 306 | TAGATCATAAAAGAC | Deoxy, MOE, and cEt | 0 | 3395 | 3410 | 3960 |
| 561073 | 293 | 308 | GATAGATCATAAAAG | Deoxy, MOE, and cEt | 15 | 3397 | 3412 | 3961 |
| 561074 | 295 | 310 | GCGATAGATCATAAAA | Deoxy, MOE, and cEt | 39 | 3399 | 3414 | 3962 |
| 561075 | 297 | 312 | CAGCGATAGATCATAA | Deoxy, MOE, and cEt | 53 | 3401 | 3416 | 3963 |
| 561076 | 299 | 314 | TGCAGCGATAGATCAT | Deoxy, MOE, and cEt | 70 | 3403 | 3418 | 159 |
| 561077 | 301 | 316 | TTTGCAGCGATAGATC | Deoxy, MOE, and cEt | 60 | 3405 | 3420 | 3964 |
| 561078 | 303 | 318 | GGTTTGCAGCGATAGA | Deoxy, MOE, and cEt | 63 | 3407 | 3422 | 3965 |
| 561079 | 305 | 320 | CTGGTTTGCAGCGATA | Deoxy, MOE, and cEt | 76 | 3409 | 3424 | 160 |
| 561080 | 307 | 322 | CACTGGTTTGCAGCGA | Deoxy, MOE, and cEt | 65 | 3411 | 3426 | 3966 |
| 561081 | 309 | 324 | TTCACTGGTTTGCAGC | Deoxy, MOE, and cEt | 45 | 3413 | 3428 | 3967 |
| 561082 | 311 | 326 | ATTTCACTGGTTTGCA | Deoxy, MOE, and cEt | 56 | 3415 | 3430 | 3968 |
| 561083 | 313 | 328 | TGATTTCACTGGTTTG | Deoxy, MOE, and cEt | 65 | 3417 | 3432 | 3969 |
| 561084 | 316 | 331 | CTTTGATTTCACTGGT | Deoxy, MOE, and cEt | 73 | 3420 | 3435 | 161 |
| 561085 | 341 | 356 | GTTCTTCTCAGTTCCT | Deoxy, MOE, and cEt | 79 | 3445 | 3460 | 162 |
| 561086 | 343 | 358 | TAGTTCTTCTCAGTTC | Deoxy, MOE, and cEt | 50 | 3447 | 3462 | 3970 |
| 561087 | 345 | 360 | TGTAGTTCTTCTCAGT | Deoxy, MOE, and cEt | 42 | 3449 | 3464 | 3971 |
| 561088 | 347 | 362 | TATGTAGTTCTTCTCA | Deoxy, MOE, and cEt | 27 | 3451 | 3466 | 3972 |

TABLE 28-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561089 | 349 | 364 | TATATGTAGTTCTTCT | Deoxy, MOE, and cEt | 37 | 3453 | 3468 | 3973 |
| 561090 | 352 | 367 | GTTTATATGTAGTTCT | Deoxy, MOE, and cEt | 39 | 3456 | 3471 | 3974 |
| 561091 | 355 | 370 | GTAGTTTATATGTAGT | Deoxy, MOE, and cEt | 55 | 3459 | 3474 | 3975 |
| 561092 | 358 | 373 | CTTGTAGTTTATATGT | Deoxy, MOE, and cEt | 48 | 3462 | 3477 | 3976 |
| 561093 | 360 | 375 | GACTTGTAGTTTATAT | Deoxy, MOE, and cEt | 43 | 3464 | 3479 | 3977 |
| 561094 | 362 | 377 | TTGACTTGTAGTTTAT | Deoxy, MOE, and cEt | 35 | 3466 | 3481 | 3978 |
| 561095 | 365 | 380 | TTTTTGACTTGTAGTT | Deoxy, MOE, and cEt | 37 | 3469 | 3484 | 3979 |
| 561096 | 367 | 382 | CATTTTTGACTTGTAG | Deoxy, MOE, and cEt | 34 | 3471 | 3486 | 3980 |
| 561097 | 373 | 388 | CCTCTTCATTTTTGAC | Deoxy, MOE, and cEt | 48 | 3477 | 3492 | 3981 |
| 561098 | 386 | 401 | GACATATTCTTTACCT | Deoxy, MOE, and cEt | 40 | 3490 | 3505 | 3982 |
| 561099 | 388 | 403 | GTGACATATTCTTTAC | Deoxy, MOE, and cEt | 43 | 3492 | 3507 | 3983 |
| 561100 | 393 | 408 | TTCAAGTGACATATTC | Deoxy, MOE, and cEt | 51 | 3497 | 3512 | 3984 |
| 561101 | 395 | 410 | AGTTCAAGTGACATAT | Deoxy, MOE, and cEt | 27 | 3499 | 3514 | 3985 |
| 561102 | 397 | 412 | TGAGTTCAAGTGACAT | Deoxy, MOE, and cEt | 63 | 3501 | 3516 | 3986 |
| 561103 | 399 | 414 | GTTGAGTTCAAGTGAC | Deoxy, MOE, and cEt | 48 | 3503 | 3518 | 3987 |
| 561104 | 401 | 416 | GAGTTGAGTTCAAGTG | Deoxy, MOE, and cEt | 57 | 3505 | 3520 | 3988 |
| 561105 | 403 | 418 | TTGAGTTGAGTTCAAG | Deoxy, MOE, and cEt | 32 | 3507 | 3522 | 3989 |
| 561106 | 405 | 420 | TTTTGAGTTGAGTTCA | Deoxy, MOE, and cEt | 47 | 3509 | 3524 | 3990 |
| 561107 | 407 | 422 | AGTTTTGAGTTGAGTT | Deoxy, MOE, and cEt | 46 | 3511 | 3526 | 3991 |
| 561108 | 409 | 424 | CAAGTTTTGAGTTGAG | Deoxy, MOE, and cEt | 48 | 3513 | 3528 | 3992 |
| 561109 | 411 | 426 | TTCAAGTTTTGAGTTG | Deoxy, MOE, and cEt | 17 | 3515 | 3530 | 3993 |
| 561110 | 413 | 428 | CTTTCAAGTTTTGAGT | Deoxy, MOE, and cEt | 48 | 3517 | 3532 | 3994 |
| 561111 | 415 | 430 | GGCTTTCAAGTTTTGA | Deoxy, MOE, and cEt | 56 | 3519 | 3534 | 3995 |
| 561112 | 417 | 432 | GAGGCTTTCAAGTTTT | Deoxy, MOE, and cEt | 39 | 3521 | 3536 | 3996 |
| 561113 | 419 | 434 | AGGAGGCTTTCAAGTT | Deoxy, MOE, and cEt | 49 | 3523 | 3538 | 3997 |
| 561114 | 421 | 436 | CTAGGAGGCTTTCAAG | Deoxy, MOE, and cEt | 49 | 3525 | 3540 | 3998 |
| 561115 | 423 | 438 | TTCTAGGAGGCTTTCA | Deoxy, MOE, and cEt | 40 | 3527 | 3542 | 3999 |
| 561116 | 425 | 440 | TCTTCTAGGAGGCTTT | Deoxy, MOE, and cEt | 66 | 3529 | 3544 | 4000 |
| 561117 | 427 | 442 | TTTCTTCTAGGAGGCT | Deoxy, MOE, and cEt | 74 | 3531 | 3546 | 4001 |
| 561118 | 442 | 457 | GTTGAAGTAGAATTTT | Deoxy, MOE, and cEt | 40 | 3546 | 3561 | 4002 |
| 561119 | 469 | 484 | GTTGCTCTTCTAAATA | Deoxy, MOE, and cEt | 44 | 3573 | 3588 | 4003 |
| 561120 | 471 | 486 | TAGTTGCTCTTCTAAA | Deoxy, MOE, and cEt | 19 | 3575 | 3590 | 4004 |
| 561121 | 473 | 488 | GTTAGTTGCTCTTCTA | Deoxy, MOE, and cEt | 67 | 3577 | 3592 | 4005 |
| 561122 | 475 | 490 | TAGTTAGTTGCTCTTC | Deoxy, MOE, and cEt | 51 | 3579 | 3594 | 4006 |
| 561123 | 477 | 492 | GTTAGTTAGTTGCTCT | Deoxy, MOE, and cEt | 73 | 3581 | 3596 | 163 |
| 561124 | 479 | 494 | AAGTTAGTTAGTTGCT | Deoxy, MOE, and cEt | 51 | 3583 | 3598 | 4007 |

TABLE 28-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
| --- | --- | --- | --- | --- | --- | --- | --- | --- |
| 561125 | 481 | 496 | TTAAGTTAGTTAGTTG | Deoxy, MOE, and cEt | 33 | 3585 | 3600 | 4008 |
| 561126 | 483 | 498 | AATTAAGTTAGTTAGT | Deoxy, MOE, and cEt | 0 | 3587 | 3602 | 4009 |
| 561127 | 485 | 500 | TGAATTAAGTTAGTTA | Deoxy, MOE, and cEt | 5 | 3589 | 3604 | 4010 |
| 561128 | 487 | 502 | TTTGAATTAAGTTAGT | Deoxy, MOE, and cEt | 18 | 3591 | 3606 | 4011 |
| 561129 | 494 | 509 | GGTTGATTTTGAATTA | Deoxy, MOE, and cEt | 20 | 3598 | 3613 | 4012 |
| 561130 | 496 | 511 | CAGGTTGATTTTGAAT | Deoxy, MOE, and cEt | 27 | 3600 | 3615 | 4013 |
| 561131 | 498 | 513 | TTCAGGTTGATTTTGA | Deoxy, MOE, and cEt | 33 | 3602 | 3617 | 4014 |
| 561132 | 500 | 515 | GTTTCAGGTTGATTTT | Deoxy, MOE, and cEt | 38 | 3604 | 3619 | 4015 |
| 561133 | 502 | 517 | GAGTTTCAGGTTGATT | Deoxy, MOE, and cEt | 33 | 3606 | 3621 | 4016 |
| 561134 | 504 | 519 | TGGAGTTTCAGGTTGA | Deoxy, MOE, and cEt | 67 | 3608 | 3623 | 4017 |
| 561135 | 507 | 522 | TTCTGGAGTTTCAGGT | Deoxy, MOE, and cEt | 32 | 3611 | 3626 | 4018 |
| 561136 | 509 | 524 | TGTTCTGGAGTTTCAG | Deoxy, MOE, and cEt | 14 | 3613 | 3628 | 4019 |
| 561137 | 511 | 526 | GGTGTTCTGGAGTTTC | Deoxy, MOE, and cEt | 23 | 3615 | 3630 | 4020 |
| 561138 | 513 | 528 | TGGGTGTTCTGGAGTT | Deoxy, MOE, and cEt | 30 | 3617 | 3632 | 4021 |
| 561139 | 515 | 530 | TCTGGGTGTTCTGGAG | Deoxy, MOE, and cEt | 24 | 3619 | 3634 | 4022 |
| 561140 | 517 | 532 | CTTCTGGGTGTTCTGG | Deoxy, MOE, and cEt | 17 | 3621 | 3636 | 4023 |
| 561141 | 519 | 534 | TACTTCTGGGTGTTCT | Deoxy, MOE, and cEt | 10 | 3623 | 3638 | 4024 |
| 561142 | 521 | 536 | GTTACTTCTGGGTGTT | Deoxy, MOE, and cEt | 11 | 3625 | 3640 | 4025 |
| 561143 | 523 | 538 | AAGTTACTTCTGGGTG | Deoxy, MOE, and cEt | 15 | 3627 | 3642 | 4026 |
| 560990 | 709 | 724 | TTCTTGGTGCTCTTGG | Deoxy, MOE, and cEt | 79 | 6722 | 6737 | 111 |
| 561221 | 758 | 773 | CCATCATGTTTTACAT | Deoxy, MOE, and cEt | 17 | 6771 | 6786 | 4027 |
| 561222 | 760 | 775 | TGCCATCATGTTTTAC | Deoxy, MOE, and cEt | 22 | N/A | N/A | 4028 |
| 561223 | 763 | 778 | GAATGCCATCATGTTT | Deoxy, MOE, and cEt | 12 | N/A | N/A | 4029 |
| 561224 | 765 | 780 | AGGAATGCCATCATGT | Deoxy, MOE, and cEt | 26 | N/A | N/A | 4030 |
| 561225 | 767 | 782 | GCAGGAATGCCATCAT | Deoxy, MOE, and cEt | 32 | N/A | N/A | 4031 |
| 561226 | 769 | 784 | CAGCAGGAATGCCATC | Deoxy, MOE, and cEt | 29 | N/A | N/A | 4032 |
| 561227 | 771 | 786 | TTCAGCAGGAATGCCA | Deoxy, MOE, and cEt | 22 | N/A | N/A | 4033 |
| 561228 | 773 | 788 | CATTCAGCAGGAATGC | Deoxy, MOE, and cEt | 23 | 7358 | 7373 | 4034 |
| 561229 | 775 | 790 | TACATTCAGCAGGAAT | Deoxy, MOE, and cEt | 28 | 7360 | 7375 | 4035 |
| 561230 | 777 | 792 | GGTACATTCAGCAGGA | Deoxy, MOE, and cEt | 61 | 7362 | 7377 | 4036 |
| 561231 | 779 | 794 | GTGGTACATTCAGCAG | Deoxy, MOE, and cEt | 57 | 7364 | 7379 | 4037 |
| 561232 | 781 | 796 | TGGTGGTACATTCAGC | Deoxy, MOE, and cEt | 59 | 7366 | 7381 | 4038 |
| 561233 | 787 | 802 | TATAAATGGTGGTACA | Deoxy, MOE, and cEt | 51 | 7372 | 7387 | 4039 |
| 561234 | 789 | 804 | GTTATAAATGGTGGTA | Deoxy, MOE, and cEt | 50 | 7374 | 7389 | 4040 |
| 561235 | 791 | 806 | CTGTTATAAATGGTGG | Deoxy, MOE, and cEt | 49 | 7376 | 7391 | 4041 |
| 561236 | 793 | 808 | CTCTGTTATAAATGGT | Deoxy, MOE, and cEt | 39 | 7378 | 7393 | 4042 |

TABLE 28-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561237 | 795 | 810 | ACCTCTGTTATAAATG | Deoxy, MOE, and cEt | 47 | 7380 | 7395 | 4043 |
| 561238 | 797 | 812 | TCACCTCTGTTATAAA | Deoxy, MOE, and cEt | 44 | 7382 | 7397 | 4044 |
| 561239 | 799 | 814 | GTTCACCTCTGTTATA | Deoxy, MOE, and cEt | 43 | 7384 | 7399 | 4045 |
| 561240 | 801 | 816 | ATGTTCACCTCTGTTA | Deoxy, MOE, and cEt | 59 | 7386 | 7401 | 4046 |
| 561241 | 803 | 818 | GTATGTTCACCTCTGT | Deoxy, MOE, and cEt | 69 | 7388 | 7403 | 164 |
| 337487 | 804 | 823 | CACTTGTATGTTCACCTCTG | 5-10-5 MOE | 74 | 7389 | 7408 | 28 |
| 561242 | 805 | 820 | TTGTATGTTCACCTCT | Deoxy, MOE, and cEt | 63 | 7390 | 7405 | 4047 |
| 561243 | 807 | 822 | ACTTGTATGTTCACCT | Deoxy, MOE, and cEt | 63 | 7392 | 7407 | 4048 |
| 561244 | 809 | 824 | CCACTTGTATGTTCAC | Deoxy, MOE, and cEt | 57 | 7394 | 7409 | 4049 |
| 561245 | 811 | 826 | TGCCACTTGTATGTTC | Deoxy, MOE, and cEt | 36 | 7396 | 7411 | 4050 |
| 561246 | 813 | 828 | CATGCCACTTGTATGT | Deoxy, MOE, and cEt | 33 | 7398 | 7413 | 4051 |
| 561247 | 815 | 830 | TACATGCCACTTGTAT | Deoxy, MOE, and cEt | 37 | 7400 | 7415 | 4052 |
| 561248 | 817 | 832 | CATACATGCCACTTGT | Deoxy, MOE, and cEt | 36 | 7402 | 7417 | 4053 |
| 561249 | 819 | 834 | GGCATACATGCCACTT | Deoxy, MOE, and cEt | 20 | 7404 | 7419 | 4054 |
| 561250 | 821 | 836 | ATGGCATACATGCCAC | Deoxy, MOE, and cEt | 0 | 7406 | 7421 | 4055 |
| 561251 | 823 | 838 | TGATGGCATACATGCC | Deoxy, MOE, and cEt | 22 | 7408 | 7423 | 4056 |
| 561252 | 825 | 840 | TCTGATGGCATACATG | Deoxy, MOE, and cEt | 34 | 7410 | 7425 | 4057 |
| 561253 | 827 | 842 | GGTCTGATGGCATACA | Deoxy, MOE, and cEt | 46 | 7412 | 7427 | 4058 |
| 561254 | 829 | 844 | TGGGTCTGATGGCATA | Deoxy, MOE, and cEt | 51 | 7414 | 7429 | 4059 |
| 561255 | 834 | 849 | GTTGCTGGGTCTGATG | Deoxy, MOE, and cEt | 45 | 7419 | 7434 | 4060 |
| 561256 | 836 | 851 | GAGTTGCTGGGTCTGA | Deoxy, MOE, and cEt | 70 | 7421 | 7436 | 165 |
| 561257 | 838 | 853 | GAGAGTTGCTGGGTCT | Deoxy, MOE, and cEt | 57 | 7423 | 7438 | 4061 |
| 561258 | 840 | 855 | TTGAGAGTTGCTGGGT | Deoxy, MOE, and cEt | 47 | 7425 | 7440 | 4062 |
| 561259 | 842 | 857 | ACTTGAGAGTTGCTGG | Deoxy, MOE, and cEt | 53 | 7427 | 7442 | 4063 |
| 561260 | 844 | 859 | AAACTTGAGAGTTGCT | Deoxy, MOE, and cEt | 71 | 7429 | 7444 | 166 |
| 561261 | 846 | 861 | AAAAACTTGAGAGTTG | Deoxy, MOE, and cEt | 23 | 7431 | 7446 | 4064 |
| 561262 | 848 | 863 | TGAAAACTTGAGAGT | Deoxy, MOE, and cEt | 11 | 7433 | 7448 | 4065 |
| 561263 | 850 | 865 | CATGAAAACTTGAGA | Deoxy, MOE, and cEt | 34 | 7435 | 7450 | 4066 |
| 561264 | 852 | 867 | GACATGAAAACTTGA | Deoxy, MOE, and cEt | 25 | 7437 | 7452 | 4067 |
| 561265 | 860 | 875 | TCACAGTAGACATGAA | Deoxy, MOE, and cEt | 16 | 7445 | 7460 | 4068 |
| 561266 | 862 | 877 | CATCACAGTAGACATG | Deoxy, MOE, and cEt | 37 | 7447 | 7462 | 4069 |
| 561267 | 864 | 879 | AACATCACAGTAGACA | Deoxy, MOE, and cEt | 57 | 7449 | 7464 | 4070 |
| 561268 | 866 | 881 | ATAACATCACAGTAGA | Deoxy, MOE, and cEt | 40 | 7451 | 7466 | 4071 |
| 561269 | 868 | 883 | ATATAACATCACAGTA | Deoxy, MOE, and cEt | 26 | 7453 | 7468 | 4072 |
| 561270 | 870 | 885 | TGATATAACATCACAG | Deoxy, MOE, and cEt | 35 | 7455 | 7470 | 4073 |
| 561271 | 872 | 887 | CCTGATATAACATCAC | Deoxy, MOE, and cEt | 60 | 7457 | 7472 | 4074 |

TABLE 28-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561272 | 874 | 889 | TACCTGATATAACATC | Deoxy, MOE, and cEt | 37 | 7459 | 7474 | 4075 |
| 561273 | 876 | 891 | ACTACCTGATATAACA | Deoxy, MOE, and cEt | 24 | N/A | N/A | 4076 |
| 561274 | 878 | 893 | GGACTACCTGATATAA | Deoxy, MOE, and cEt | 7 | N/A | N/A | 4077 |
| 561275 | 880 | 895 | ATGGACTACCTGATAT | Deoxy, MOE, and cEt | 33 | N/A | N/A | 4078 |
| 561276 | 882 | 897 | CCATGGACTACCTGAT | Deoxy, MOE, and cEt | 52 | N/A | N/A | 4079 |
| 561277 | 884 | 899 | GTCCATGGACTACCTG | Deoxy, MOE, and cEt | 71 | 7871 | 7886 | 167 |
| 561278 | 886 | 901 | ATGTCCATGGACTACC | Deoxy, MOE, and cEt | 67 | 7873 | 7888 | 4080 |
| 561279 | 888 | 903 | TAATGTCCATGGACTA | Deoxy, MOE, and cEt | 44 | 7875 | 7890 | 4081 |
| 559390 | 890 | 905 | ATTAATGTCCATGGAC | Deoxy, MOE, and cEt | 28 | 7877 | 7892 | 4082 |
| 561280 | 892 | 907 | GAATTAATGTCCATGG | Deoxy, MOE, and cEt | 51 | 7879 | 7894 | 4083 |
| 561281 | 894 | 909 | TTGAATTAATGTCCAT | Deoxy, MOE, and cEt | 30 | 7881 | 7896 | 4084 |
| 561282 | 896 | 911 | TGTTGAATTAATGTCC | Deoxy, MOE, and cEt | 38 | 7883 | 7898 | 4085 |
| 561283 | 898 | 913 | GATGTTGAATTAATGT | Deoxy, MOE, and cEt | 11 | 7885 | 7900 | 4086 |
| 561284 | 900 | 915 | TCGATGTTGAATTAAT | Deoxy, MOE, and cEt | 20 | 7887 | 7902 | 4087 |
| 561285 | 902 | 917 | ATTCGATGTTGAATTA | Deoxy, MOE, and cEt | 12 | 7889 | 7904 | 4088 |
| 561286 | 904 | 919 | CTATTCGATGTTGAAT | Deoxy, MOE, and cEt | 17 | 7891 | 7906 | 4089 |
| 561287 | 906 | 921 | ATCTATTCGATGTTGA | Deoxy, MOE, and cEt | 32 | 7893 | 7908 | 4090 |
| 561288 | 908 | 923 | CCATCTATTCGATGTT | Deoxy, MOE, and cEt | 69 | 7895 | 7910 | 168 |
| 561289 | 910 | 925 | ATCCATCTATTCGATG | Deoxy, MOE, and cEt | 32 | 7897 | 7912 | 4091 |
| 561290 | 912 | 927 | TGATCCATCTATTCGA | Deoxy, MOE, and cEt | 41 | 7899 | 7914 | 4092 |
| 561291 | 914 | 929 | TGTGATCCATCTATTC | Deoxy, MOE, and cEt | 50 | 7901 | 7916 | 4093 |
| 561292 | 916 | 931 | TTTGTGATCCATCTAT | Deoxy, MOE, and cEt | 50 | 7903 | 7918 | 4094 |
| 561293 | 918 | 933 | GTTTTGTGATCCATCT | Deoxy, MOE, and cEt | 41 | 7905 | 7920 | 4095 |
| 561294 | 920 | 935 | AAGTTTTGTGATCCAT | Deoxy, MOE, and cEt | 56 | 7907 | 7922 | 4096 |
| 561295 | 922 | 937 | TGAAGTTTTGTGATCC | Deoxy, MOE, and cEt | 57 | 7909 | 7924 | 4097 |
| 561296 | 924 | 939 | ATTGAAGTTTTGTGAT | Deoxy, MOE, and cEt | 0 | 7911 | 7926 | 4098 |
| 561450 | 1386 | 1401 | CAACATTTTGGTTGAT | Deoxy, MOE, and cEt | 45 | 10358 | 10373 | 4099 |
| 561451 | 1389 | 1404 | GATCAACATTTTGGTT | Deoxy, MOE, and cEt | 33 | 10361 | 10376 | 4100 |
| 561452 | 1391 | 1406 | TGGATCAACATTTTGG | Deoxy, MOE, and cEt | 81 | 10363 | 10378 | 123 |
| 561453 | 1393 | 1408 | GATGGATCAACATTTT | Deoxy, MOE, and cEt | 59 | 10365 | 10380 | 4101 |
| 561455 | 1397 | 1412 | GTTGGATGGATCAACA | Deoxy, MOE, and cEt | 53 | 10369 | 10384 | 4102 |
| 561456 | 1399 | 1414 | CTGTTGGATGGATCAA | Deoxy, MOE, and cEt | 71 | 10371 | 10386 | 4103 |
| 561457 | 1401 | 1416 | ATCTGTTGGATGGATC | Deoxy, MOE, and cEt | 71 | 10373 | 10388 | 4104 |
| 561458 | 1403 | 1418 | GAATCTGTTGGATGGA | Deoxy, MOE, and cEt | 84 | 10375 | 10390 | 124 |
| 561459 | 1405 | 1420 | CTGAATCTGTTGGATG | Deoxy, MOE, and cEt | 72 | 10377 | 10392 | 4105 |
| 561460 | 1407 | 1422 | TTCTGAATCTGTTGGA | Deoxy, MOE, and cEt | 78 | 10379 | 10394 | 125 |

TABLE 28-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561461 | 1414 | 1429 | CAAAGCTTTCTGAATC | Deoxy, MOE, and cEt | 45 | 10386 | 10401 | 4106 |
| 561462 | 1421 | 1436 | GTTCATTCAAAGCTTT | Deoxy, MOE, and cEt | 87 | 10393 | 10408 | 126 |
| 561463 | 1423 | 1438 | CAGTTCATTCAAAGCT | Deoxy, MOE, and cEt | 85 | 10395 | 10410 | 127 |
| 561464 | 1425 | 1440 | CTCAGTTCATTCAAAG | Deoxy, MOE, and cEt | 47 | 10397 | 10412 | 4107 |
| 561465 | 1427 | 1442 | GCCTCAGTTCATTCAA | Deoxy, MOE, and cEt | 60 | 10399 | 10414 | 4108 |
| 561466 | 1429 | 1444 | TTGCCTCAGTTCATTC | Deoxy, MOE, and cEt | 68 | 10401 | 10416 | 4109 |
| 561467 | 1431 | 1446 | ATTTGCCTCAGTTCAT | Deoxy, MOE, and cEt | 61 | 10403 | 10418 | 4110 |
| 561468 | 1433 | 1448 | AAATTTGCCTCAGTTC | Deoxy, MOE, and cEt | 48 | 10405 | 10420 | 4111 |
| 561469 | 1436 | 1451 | TTTAAATTTGCCTCAG | Deoxy, MOE, and cEt | 59 | 10408 | 10423 | 4112 |
| 561470 | 1438 | 1453 | CTTTTAAATTTGCCTC | Deoxy, MOE, and cEt | 50 | 10410 | 10425 | 4113 |
| 561471 | 1440 | 1455 | GCCTTTTAAATTTGCC | Deoxy, MOE, and cEt | 73 | 10412 | 10427 | 4114 |
| 561472 | 1452 | 1467 | GTTTAAATTATTGCCT | Deoxy, MOE, and cEt | 48 | 10424 | 10439 | 4115 |
| 561473 | 1463 | 1478 | ATGAGGTTAATGTTTA | Deoxy, MOE, and cEt | 33 | 10435 | 10450 | 4116 |
| 561474 | 1465 | 1480 | GAATGAGGTTAATGTT | Deoxy, MOE, and cEt | 29 | 10437 | 10452 | 4117 |
| 561475 | 1467 | 1482 | TGGAATGAGGTTAATG | Deoxy, MOE, and cEt | 66 | 10439 | 10454 | 4118 |
| 561476 | 1469 | 1484 | CTTGGAATGAGGTTAA | Deoxy, MOE, and cEt | 72 | 10441 | 10456 | 4119 |
| 561477 | 1471 | 1486 | AACTTGGAATGAGGTT | Deoxy, MOE, and cEt | 69 | 10443 | 10458 | 4120 |
| 561478 | 1473 | 1488 | TTAACTTGGAATGAGG | Deoxy, MOE, and cEt | 74 | 10445 | 10460 | 128 |
| 561479 | 1475 | 1490 | CATTAACTTGGAATGA | Deoxy, MOE, and cEt | 5 | 10447 | 10462 | 4121 |
| 561480 | 1477 | 1492 | CACATTAACTTGGAAT | Deoxy, MOE, and cEt | 26 | 10449 | 10464 | 4122 |
| 561481 | 1479 | 1494 | ACCACATTAACTTGGA | Deoxy, MOE, and cEt | 59 | 10451 | 10466 | 4123 |
| 561482 | 1481 | 1496 | AGACCACATTAACTTG | Deoxy, MOE, and cEt | 76 | 10453 | 10468 | 129 |
| 561483 | 1483 | 1498 | TTAGACCACATTAACT | Deoxy, MOE, and cEt | 47 | 10455 | 10470 | 4124 |
| 561484 | 1485 | 1500 | TATTAGACCACATTAA | Deoxy, MOE, and cEt | 38 | 10457 | 10472 | 4125 |
| 561485 | 1487 | 1502 | ATTATTAGACCACATT | Deoxy, MOE, and cEt | 59 | 10459 | 10474 | 4126 |
| 561486 | 1489 | 1504 | AGATTATTAGACCACA | Deoxy, MOE, and cEt | 84 | 10461 | 10476 | 130 |
| 561487 | 1491 | 1506 | CCAGATTATTAGACCA | Deoxy, MOE, and cEt | 93 | 10463 | 10478 | 131 |
| 561488 | 1493 | 1508 | TACCAGATTATTAGAC | Deoxy, MOE, and cEt | 22 | 10465 | 10480 | 4127 |
| 561489 | 1495 | 1510 | AATACCAGATTATTAG | Deoxy, MOE, and cEt | 48 | 10467 | 10482 | 4128 |
| 561490 | 1497 | 1512 | TTAATACCAGATTATT | Deoxy, MOE, and cEt | 22 | 10469 | 10484 | 4129 |
| 561491 | 1499 | 1514 | ATTTAATACCAGATTA | Deoxy, MOE, and cEt | 14 | 10471 | 10486 | 4130 |
| 561492 | 1501 | 1516 | GGATTTAATACCAGAT | Deoxy, MOE, and cEt | 74 | 10473 | 10488 | 4131 |
| 561493 | 1503 | 1518 | AAGGATTTAATACCAG | Deoxy, MOE, and cEt | 70 | 10475 | 10490 | 4132 |
| 561494 | 1505 | 1520 | TTAAGGATTTAATACC | Deoxy, MOE, and cEt | 14 | 10477 | 10492 | 4133 |
| 561495 | 1508 | 1523 | CTCTTAAGGATTTAAT | Deoxy, MOE, and cEt | 12 | 10480 | 10495 | 4134 |
| 561496 | 1510 | 1525 | TTCTCTTAAGGATTTA | Deoxy, MOE, and cEt | 47 | 10482 | 10497 | 4135 |

TABLE 28-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561497 | 1513 | 1528 | GCTTTCTCTTAAGGAT | Deoxy, MOE, and cEt | 73 | 10485 | 10500 | 4136 |
| 561498 | 1515 | 1530 | AAGCTTTCTCTTAAGG | Deoxy, MOE, and cEt | 59 | 10487 | 10502 | 4137 |
| 561499 | 1517 | 1532 | TCAAGCTTTCTCTTAA | Deoxy, MOE, and cEt | 62 | 10489 | 10504 | 4138 |
| 561500 | 1526 | 1541 | ATCTATTTCTCAAGCT | Deoxy, MOE, and cEt | 76 | 10498 | 10513 | 132 |
| 561501 | 1547 | 1562 | AGTGACTTTAAGATAA | Deoxy, MOE, and cEt | 23 | 10519 | 10534 | 4139 |
| 561502 | 1549 | 1564 | ACAGTGACTTTAAGAT | Deoxy, MOE, and cEt | 62 | 10521 | 10536 | 4140 |
| 561503 | 1551 | 1566 | AGACAGTGACTTTAAG | Deoxy, MOE, and cEt | 55 | 10523 | 10538 | 4141 |
| 561504 | 1553 | 1568 | ATAGACAGTGACTTTA | Deoxy, MOE, and cEt | 74 | 10525 | 10540 | 133 |
| 561505 | 1555 | 1570 | AAATAGACAGTGACTT | Deoxy, MOE, and cEt | 59 | 10527 | 10542 | 4142 |
| 561506 | 1557 | 1572 | TTAAATAGACAGTGAC | Deoxy, MOE, and cEt | 38 | 10529 | 10544 | 4143 |
| 561507 | 1559 | 1574 | TCTTAAATAGACAGTG | Deoxy, MOE, and cEt | 54 | 10531 | 10546 | 4144 |
| 561508 | 1561 | 1576 | AATCTTAAATAGACAG | Deoxy, MOE, and cEt | 22 | 10533 | 10548 | 4145 |
| 561509 | 1563 | 1578 | TTAATCTTAAATAGAC | Deoxy, MOE, and cEt | 0 | 10535 | 10550 | 4146 |
| 561510 | 1565 | 1580 | GTTTAATCTTAAATAG | Deoxy, MOE, and cEt | 0 | 10537 | 10552 | 4147 |
| 561511 | 1569 | 1584 | GTATGTTTAATCTTAA | Deoxy, MOE, and cEt | 13 | 10541 | 10556 | 4148 |
| 561512 | 1572 | 1587 | ATTGTATGTTTAATCT | Deoxy, MOE, and cEt | 40 | 10544 | 10559 | 4149 |
| 561513 | 1575 | 1590 | GTGATTGTATGTTTAA | Deoxy, MOE, and cEt | 71 | 10547 | 10562 | 4150 |
| 561514 | 1578 | 1593 | TATGTGATTGTATGTT | Deoxy, MOE, and cEt | 58 | 10550 | 10565 | 4151 |
| 561515 | 1580 | 1595 | GTTATGTGATTGTATG | Deoxy, MOE, and cEt | 68 | 10552 | 10567 | 4152 |
| 561516 | 1582 | 1597 | AGGTTATGTGATTGTA | Deoxy, MOE, and cEt | 73 | 10554 | 10569 | 4153 |
| 561517 | 1584 | 1599 | TAAGGTTATGTGATTG | Deoxy, MOE, and cEt | 64 | 10556 | 10571 | 4154 |
| 561518 | 1586 | 1601 | TTTAAGGTTATGTGAT | Deoxy, MOE, and cEt | 0 | 10558 | 10573 | 4155 |
| 561519 | 1588 | 1603 | TCTTTAAGGTTATGTG | Deoxy, MOE, and cEt | 53 | 10560 | 10575 | 4156 |
| 561520 | 1590 | 1605 | ATTCTTTAAGGTTATG | Deoxy, MOE, and cEt | 29 | 10562 | 10577 | 4157 |
| 561521 | 1592 | 1607 | GTATTCTTTAAGGTTA | Deoxy, MOE, and cEt | 24 | 10564 | 10579 | 4158 |
| 561522 | 1594 | 1609 | CGGTATTCTTTAAGGT | Deoxy, MOE, and cEt | 70 | 10566 | 10581 | 4159 |
| 561523 | 1596 | 1611 | AACGGTATTCTTTAAG | Deoxy, MOE, and cEt | 42 | 10568 | 10583 | 4160 |
| 561524 | 1598 | 1613 | TAAACGGTATTCTTTA | Deoxy, MOE, and cEt | 26 | 10570 | 10585 | 4161 |
| 561525 | 1600 | 1615 | TGTAAACGGTATTCTT | Deoxy, MOE, and cEt | 59 | 10572 | 10587 | 4162 |
| 561526 | 1602 | 1617 | AATGTAAACGGTATTC | Deoxy, MOE, and cEt | 57 | 10574 | 10589 | 4142 |

TABLE 29

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561681 | N/A | N/A | TCTGGAAGCAGACCTA | Deoxy, MOE, and cEt | 37 | 3096 | 3111 | 4164 |
| 561682 | N/A | N/A | CTTCTGGAAGCAGACC | Deoxy, MOE, and cEt | 27 | 3098 | 3113 | 4165 |
| 561683 | N/A | N/A | AAATAAGGTATAGTGA | Deoxy, MOE, and cEt | 2 | 11084 | 11099 | 4166 |
| 561684 | N/A | N/A | TAGTATTAAGTGTTAA | Deoxy, MOE, and cEt | 14 | 11133 | 11148 | 4167 |
| 561685 | N/A | N/A | TCATAGTATTAAGTGT | Deoxy, MOE, and cEt | 0 | 11136 | 11151 | 4168 |
| 561686 | N/A | N/A | AGATTCCTTTACAATT | Deoxy, MOE, and cEt | 21 | 11160 | 11175 | 4169 |
| 561687 | N/A | N/A | ACAAGATTCCTTTACA | Deoxy, MOE, and cEt | 21 | 11163 | 11178 | 4170 |
| 561688 | N/A | N/A | CTGACAAGATTCCTTT | Deoxy, MOE, and cEt | 70 | 11166 | 11181 | 4171 |
| 561689 | N/A | N/A | AATCTGACAAGATTCC | Deoxy, MOE, and cEt | 83 | 11169 | 11184 | 180 |
| 561690 | N/A | N/A | TGTAATCTGACAAGAT | Deoxy, MOE, and cEt | 46 | 11172 | 11187 | 4172 |
| 561691 | N/A | N/A | TACTGTAATCTGACAA | Deoxy, MOE, and cEt | 47 | 11175 | 11190 | 4173 |
| 561692 | N/A | N/A | TCTTACTGTAATCTGA | Deoxy, MOE, and cEt | 50 | 11178 | 11193 | 4174 |
| 561693 | N/A | N/A | CATTCTTACTGTAATC | Deoxy, MOE, and cEt | 40 | 11181 | 11196 | 4175 |
| 561694 | N/A | N/A | GTTCATTCTTACTGTA | Deoxy, MOE, and cEt | 71 | 11184 | 11199 | 4176 |
| 561695 | N/A | N/A | ATATGTTCATTCTTAC | Deoxy, MOE, and cEt | 2 | 11188 | 11203 | 4177 |
| 561696 | N/A | N/A | GCCACAAATATGTTCA | Deoxy, MOE, and cEt | 80 | 11195 | 11210 | 4178 |
| 561697 | N/A | N/A | GATGCCACAAATATGT | Deoxy, MOE, and cEt | 70 | 11198 | 11213 | 4179 |
| 561698 | N/A | N/A | CTCGATGCCACAAATA | Deoxy, MOE, and cEt | 80 | 11201 | 11216 | 181 |
| 561699 | N/A | N/A | TAACTCGATGCCACAA | Deoxy, MOE, and cEt | 86 | 11204 | 11219 | 182 |
| 561700 | N/A | N/A | CTTTAACTCGATGCCA | Deoxy, MOE, and cEt | 77 | 11207 | 11222 | 4180 |
| 561701 | N/A | N/A | AAACTTTAACTCGATG | Deoxy, MOE, and cEt | 39 | 11210 | 11225 | 4181 |
| 561702 | N/A | N/A | TATAAACTTTAACTCG | Deoxy, MOE, and cEt | 13 | 11213 | 11228 | 4182 |
| 561703 | N/A | N/A | CACAGCATATTTAGGG | Deoxy, MOE, and cEt | 71 | 11233 | 11248 | 4183 |
| 561704 | N/A | N/A | TAGAATCACAGCATAT | Deoxy, MOE, and cEt | 68 | 11239 | 11254 | 4184 |
| 561705 | N/A | N/A | TATTAGAATCACAGCA | Deoxy, MOE, and cEt | 73 | 11242 | 11257 | 4185 |
| 561706 | N/A | N/A | AATGTATTAGAATCAC | Deoxy, MOE, and cEt | 40 | 11246 | 11261 | 4186 |
| 561707 | N/A | N/A | ACGAATGTATTAGAAT | Deoxy, MOE, and cEt | 22 | 11249 | 11264 | 4187 |
| 561708 | N/A | N/A | TACACGAATGTATTAG | Deoxy, MOE, and cEt | 33 | 11252 | 11267 | 4188 |
| 561709 | N/A | N/A | ACCTACACGAATGTAT | Deoxy, MOE, and cEt | 42 | 11255 | 11270 | 4189 |
| 561710 | N/A | N/A | AAACCTACACGAATG | Deoxy, MOE, and cEt | 24 | 11258 | 11273 | 4190 |
| 561711 | N/A | N/A | TTGAAAACCTACACGA | Deoxy, MOE, and cEt | 34 | 11261 | 11276 | 4191 |
| 561712 | N/A | N/A | TACTTGAAAACCTACA | Deoxy, MOE, and cEt | 33 | 11264 | 11279 | 4192 |
| 561713 | N/A | N/A | GTTTATTTCTACTTGA | Deoxy, MOE, and cEt | 53 | 11273 | 11288 | 4193 |
| 561714 | N/A | N/A | GAGGTTTATTTCTACT | Deoxy, MOE, and cEt | 69 | 11276 | 11291 | 4194 |
| 561715 | N/A | N/A | TACGAGGTTTATTTCT | Deoxy, MOE, and cEt | 21 | 11279 | 11294 | 4195 |
| 561716 | N/A | N/A | TGTTACGAGGTTTATT | Deoxy, MOE, and cEt | 47 | 11282 | 11297 | 4196 |

TABLE 29-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561717 | N/A | N/A | ACTTGTTACGAGGTTT | Deoxy, MOE, and cEt | 70 | 11285 | 11300 | 4197 |
| 561718 | N/A | N/A | CAGTAACTTGTTACGA | Deoxy, MOE, and cEt | 60 | 11290 | 11305 | 4198 |
| 561719 | N/A | N/A | GTTCAGTAACTTGTTA | Deoxy, MOE, and cEt | 40 | 11293 | 11308 | 4199 |
| 561720 | N/A | N/A | TCAGGCTGTTTAAACG | Deoxy, MOE, and cEt | 59 | 11308 | 11323 | 4200 |
| 561721 | N/A | N/A | TTGTCAGGCTGTTTAA | Deoxy, MOE, and cEt | 74 | 11311 | 11326 | 4201 |
| 561722 | N/A | N/A | TGCTTGTCAGGCTGTT | Deoxy, MOE, and cEt | 82 | 11314 | 11329 | 183 |
| 561723 | N/A | N/A | ACATGCTTGTCAGGCT | Deoxy, MOE, and cEt | 84 | 11317 | 11332 | 184 |
| 561724 | N/A | N/A | TATACATGCTTGTCAG | Deoxy, MOE, and cEt | 75 | 11320 | 11335 | 4202 |
| 561725 | N/A | N/A | GTCTTTGTTTATTGAA | Deoxy, MOE, and cEt | 49 | 11347 | 11362 | 4203 |
| 561726 | N/A | N/A | TGGGTCTTTGTTTATT | Deoxy, MOE, and cEt | 27 | 11350 | 11365 | 4204 |
| 561727 | N/A | N/A | GACTGGGTCTTTGTTT | Deoxy, MOE, and cEt | 20 | 11353 | 11368 | 4205 |
| 561728 | N/A | N/A | ATAATTTAGGGACTGG | Deoxy, MOE, and cEt | 20 | 11363 | 11378 | 4206 |
| 561729 | N/A | N/A | TCTATAATTTAGGGAC | Deoxy, MOE, and cEt | 39 | 11366 | 11381 | 4207 |
| 561730 | N/A | N/A | CGATAAACATGCAAGA | Deoxy, MOE, and cEt | 68 | 11394 | 11409 | 4208 |
| 561731 | N/A | N/A | TGTCGATAAACATGCA | Deoxy, MOE, and cEt | 80 | 11397 | 11412 | 4209 |
| 561732 | N/A | N/A | TGATGTCGATAAACAT | Deoxy, MOE, and cEt | 68 | 11400 | 11415 | 4210 |
| 561733 | N/A | N/A | TTGTGATGTCGATAAA | Deoxy, MOE, and cEt | 28 | 11403 | 11418 | 4211 |
| 561734 | N/A | N/A | CTGTTGTGATGTCGAT | Deoxy, MOE, and cEt | 74 | 11406 | 11421 | 4212 |
| 561735 | N/A | N/A | GATCTGTTGTGATGTC | Deoxy, MOE, and cEt | 59 | 11409 | 11424 | 4213 |
| 561736 | N/A | N/A | AGGGATCTGTTGTGAT | Deoxy, MOE, and cEt | 24 | 11412 | 11427 | 4214 |
| 561737 | N/A | N/A | TTTAGGGATCTGTTGT | Deoxy, MOE, and cEt | 19 | 11415 | 11430 | 4215 |
| 561738 | N/A | N/A | GGATTTAGGGATCTGT | Deoxy, MOE, and cEt | 27 | 11418 | 11433 | 4216 |
| 561739 | N/A | N/A | GATTTAGGGATTTAGG | Deoxy, MOE, and cEt | 44 | 11425 | 11440 | 4217 |
| 561740 | N/A | N/A | TCTTTAGGGATTTAGG | Deoxy, MOE, and cEt | 38 | 11433 | 11448 | 4218 |
| 561741 | N/A | N/A | TAATCTTTAGGGATTT | Deoxy, MOE, and cEt | 0 | 11436 | 11451 | 4219 |
| 561742 | N/A | N/A | ATCTAATCTTTAGGGA | Deoxy, MOE, and cEt | 0 | 11439 | 11454 | 4220 |
| 561743 | N/A | N/A | TGTATCTAATCTTTAG | Deoxy, MOE, and cEt | 15 | 11442 | 11457 | 4221 |
| 561744 | N/A | N/A | AAATTTGTATCTAATC | Deoxy, MOE, and cEt | 21 | 11447 | 11462 | 4222 |
| 561745 | N/A | N/A | GTAAAAATTTGTATC | Deoxy, MOE, and cEt | 23 | 11452 | 11467 | 4223 |
| 561746 | N/A | N/A | GTGGTAAAAATTTGT | Deoxy, MOE, and cEt | 32 | 11455 | 11470 | 4224 |
| 561747 | N/A | N/A | GATACTGTGGTAAAAA | Deoxy, MOE, and cEt | 45 | 11461 | 11476 | 4225 |
| 561748 | N/A | N/A | AGTGATACTGTGGTAA | Deoxy, MOE, and cEt | 60 | 11464 | 11479 | 4226 |
| 561749 | N/A | N/A | ACAAGTGATACTGTGG | Deoxy, MOE, and cEt | 75 | 11467 | 11482 | 4227 |
| 561750 | N/A | N/A | CTGACAAGTGATACTG | Deoxy, MOE, and cEt | 59 | 11470 | 11485 | 4228 |
| 561751 | N/A | N/A | ATTCTGACAAGTGATA | Deoxy, MOE, and cEt | 48 | 11473 | 11488 | 4229 |
| 561752 | N/A | N/A | TAAATTCTGACAAGTG | Deoxy, MOE, and cEt | 59 | 11476 | 11491 | 4230 |

TABLE 29-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
| --- | --- | --- | --- | --- | --- | --- | --- | --- |
| 561753 | N/A | N/A | TACTGGCAGTTTTAAA | Deoxy, MOE, and cEt | 42 | 11508 | 11523 | 4231 |
| 561754 | N/A | N/A | TCTTACTGGCAGTTTT | Deoxy, MOE, and cEt | 51 | 11511 | 11526 | 4232 |
| 561755 | N/A | N/A | ATTTCTTACTGGCAGT | Deoxy, MOE, and cEt | 69 | 11514 | 11529 | 4233 |
| 561756 | N/A | N/A | AAAATTTCTTACTGGC | Deoxy, MOE, and cEt | 57 | 11517 | 11532 | 4234 |
| 561757 | N/A | N/A | AACAAATGGGTTTAAT | Deoxy, MOE, and cEt | 0 | 11535 | 11550 | 4235 |
| 562374 | N/A | N/A | GAATATTTGCAAGTCT | Deoxy, MOE, and cEt | 68 | 9230 | 9245 | 4236 |
| 562375 | N/A | N/A | GTAGAGGAATATTTGC | Deoxy, MOE, and cEt | 83 | 9236 | 9251 | 151 |
| 562376 | N/A | N/A | TCATTGGTAGAGGAAT | Deoxy, MOE, and cEt | 23 | 9242 | 9257 | 4237 |
| 562377 | N/A | N/A | ATATTTTAAAGTCTCG | Deoxy, MOE, and cEt | 17 | 9258 | 9273 | 4238 |
| 562378 | N/A | N/A | GTTACATTATTATAGA | Deoxy, MOE, and cEt | 29 | 9273 | 9288 | 4239 |
| 562379 | N/A | N/A | GTGAAATGTGTTACAT | Deoxy, MOE, and cEt | 54 | 9282 | 9297 | 4240 |
| 562380 | N/A | N/A | TCACCAGTGAAATGTG | Deoxy, MOE, and cEt | 64 | 9288 | 9303 | 4241 |
| 562381 | N/A | N/A | CATGTTTCACCAGTGA | Deoxy, MOE, and cEt | 78 | 9294 | 9309 | 4242 |
| 562382 | N/A | N/A | ACAAGACATGTTTCAC | Deoxy, MOE, and cEt | 36 | 9300 | 9315 | 4243 |
| 562383 | N/A | N/A | CATATGACAAGACATG | Deoxy, MOE, and cEt | 42 | 9306 | 9321 | 4244 |
| 562384 | N/A | N/A | CTATAATGCATATGAC | Deoxy, MOE, and cEt | 5 | 9314 | 9329 | 4245 |
| 562385 | N/A | N/A | TCCTTTCTATAATGCA | Deoxy, MOE, and cEt | 65 | 9320 | 9335 | 4246 |
| 562386 | N/A | N/A | TGATTATCCTTTCTAT | Deoxy, MOE, and cEt | 27 | 9326 | 9341 | 4247 |
| 562387 | N/A | N/A | AAAGTCTGATTATCCT | Deoxy, MOE, and cEt | 90 | 9332 | 9347 | 152 |
| 562388 | N/A | N/A | TAACTGAAAGTCTGAT | Deoxy, MOE, and cEt | 59 | 9338 | 9353 | 4248 |
| 562389 | N/A | N/A | GTGCACAAAAATGTTA | Deoxy, MOE, and cEt | 42 | 9366 | 9381 | 4249 |
| 562390 | N/A | N/A | AGCTATGTGCACAAAA | Deoxy, MOE, and cEt | 77 | 9372 | 9387 | 4250 |
| 562391 | N/A | N/A | GAAGATAGCTATGTGC | Deoxy, MOE, and cEt | 64 | 9378 | 9393 | 4251 |
| 562392 | N/A | N/A | TTTATTGAAGATAGCT | Deoxy, MOE, and cEt | 33 | 9384 | 9399 | 4252 |
| 562393 | N/A | N/A | TCATTTAGTGTATCT | Deoxy, MOE, and cEt | 40 | 9424 | 9439 | 4253 |
| 562394 | N/A | N/A | CCTTGATCATTTTAGT | Deoxy, MOE, and cEt | 15 | 9430 | 9445 | 4254 |
| 562395 | N/A | N/A | TGAATCCCTTGATCAT | Deoxy, MOE, and cEt | 59 | 9436 | 9451 | 4255 |
| 562396 | N/A | N/A | TAGTCTTGAATCCCTT | Deoxy, MOE, and cEt | 83 | 9442 | 9457 | 153 |
| 562397 | N/A | N/A | GTTGTTAGTCTTGAA | Deoxy, MOE, and cEt | 65 | 9448 | 9463 | 4256 |
| 562398 | N/A | N/A | AATTGAGTTGTTTAGT | Deoxy, MOE, and cEt | 21 | 9454 | 9469 | 4257 |
| 562399 | N/A | N/A | GCAACTAATTGAGTTG | Deoxy, MOE, and cEt | 15 | 9460 | 9475 | 4258 |
| 562400 | N/A | N/A | ATTGGTGCAACTAATT | Deoxy, MOE, and cEt | 25 | 9466 | 9481 | 4259 |
| 562401 | N/A | N/A | GTTTTTTATTGGTGCA | Deoxy, MOE, and cEt | 53 | 9473 | 9488 | 4260 |
| 562402 | N/A | N/A | GGACACTGACAGTTTT | Deoxy, MOE, and cEt | 43 | 9496 | 9511 | 4261 |
| 562403 | N/A | N/A | CAGGTTGGACACTGAC | Deoxy, MOE, and cEt | 23 | 9502 | 9517 | 4262 |
| 562404 | N/A | N/A | TAAGTACAGGTTGGAC | Deoxy, MOE, and cEt | 33 | 9508 | 9523 | 4263 |

TABLE 29-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 562405 | N/A | N/A | AGTTATTAAGTACAGG | Deoxy, MOE, and cEt | 34 | 9514 | 9529 | 4264 |
| 562406 | N/A | N/A | TCTGTGAGTTATTAAG | Deoxy, MOE, and cEt | 10 | 9520 | 9535 | 4265 |
| 562407 | N/A | N/A | ACCAAAATTCTCCTGA | Deoxy, MOE, and cEt | 1 | 9554 | 9569 | 4266 |
| 562408 | N/A | N/A | ACCTGAATAACCCTCT | Deoxy, MOE, and cEt | 73 | 9811 | 9826 | 4267 |
| 562409 | N/A | N/A | GGTATCAGAAAAAGAT | Deoxy, MOE, and cEt | 14 | 9827 | 9842 | 4268 |
| 562410 | N/A | N/A | AGTATTGGTATCAGAA | Deoxy, MOE, and cEt | 13 | 9833 | 9848 | 4269 |
| 562411 | N/A | N/A | GGAAGATACTTTGAAG | Deoxy, MOE, and cEt | 25 | 9861 | 9876 | 4270 |
| 562412 | N/A | N/A | AATGTGGGAAGATACT | Deoxy, MOE, and cEt | 23 | 9867 | 9882 | 4271 |
| 562413 | N/A | N/A | CAGATAATAGCTAATA | Deoxy, MOE, and cEt | 29 | 9882 | 9897 | 4272 |
| 562414 | N/A | N/A | TCATTGCAGATAATAG | Deoxy, MOE, and cEt | 45 | 9888 | 9903 | 4273 |
| 562415 | N/A | N/A | AAGTTGTCATTGCAGA | Deoxy, MOE, and cEt | 86 | 9894 | 9909 | 154 |
| 562416 | N/A | N/A | GATTCGGATTTTTAAA | Deoxy, MOE, and cEt | 19 | 9909 | 9924 | 4274 |
| 562417 | N/A | N/A | ATTTGGGATTCGGATT | Deoxy, MOE, and cEt | 34 | 9915 | 9930 | 4275 |
| 562418 | N/A | N/A | ACGCTTATTTGGGATT | Deoxy, MOE, and cEt | 64 | 9921 | 9936 | 4276 |
| 562419 | N/A | N/A | TCTAGAGAGAAAACGC | Deoxy, MOE, and cEt | 64 | 9933 | 9948 | 4277 |
| 562420 | N/A | N/A | AGTTAAGAGGTTTTCG | Deoxy, MOE, and cEt | 34 | 9949 | 9964 | 4278 |
| 562421 | N/A | N/A | CATTATAGTTAAGAGG | Deoxy, MOE, and cEt | 24 | 9955 | 9970 | 4279 |
| 562422 | N/A | N/A | CACTTTCATTATAGTT | Deoxy, MOE, and cEt | 13 | 9961 | 9976 | 4280 |
| 562423 | N/A | N/A | TAGAATGAACACTTTC | Deoxy, MOE, and cEt | 63 | 9970 | 9985 | 4281 |
| 562424 | N/A | N/A | TTGAACTAGAATGAAC | Deoxy, MOE, and cEt | 16 | 9976 | 9991 | 4282 |
| 562425 | N/A | N/A | ACCTGATTGAACTAGA | Deoxy, MOE, and cEt | 51 | 9982 | 9997 | 4283 |
| 562426 | N/A | N/A | TAAAATACCTGATTGA | Deoxy, MOE, and cEt | 19 | 9988 | 10003 | 4284 |
| 562427 | N/A | N/A | TAGAGGTAAAATACCT | Deoxy, MOE, and cEt | 12 | 9994 | 10009 | 4285 |
| 562428 | N/A | N/A | GAAGATTAGAGGTAAA | Deoxy, MOE, and cEt | 1 | 10000 | 10015 | 4286 |
| 562429 | N/A | N/A | TCTGAGGAAGATTAGA | Deoxy, MOE, and cEt | 31 | 10006 | 10021 | 4287 |
| 562430 | N/A | N/A | TATACACTACCAAAAA | Deoxy, MOE, and cEt | 0 | 10030 | 10045 | 4288 |
| 562431 | N/A | N/A | ATAATCTATACACTAC | Deoxy, MOE, and cEt | 0 | 10036 | 10051 | 4289 |
| 562432 | N/A | N/A | TAAGTCCCAATTTTAA | Deoxy, MOE, and cEt | 33 | 10065 | 10080 | 4290 |
| 562433 | N/A | N/A | TCTGTATAAGTCCCAA | Deoxy, MOE, and cEt | 89 | 10071 | 10086 | 155 |
| 562434 | N/A | N/A | CCAGTTTTAAATAATC | Deoxy, MOE, and cEt | 20 | 10085 | 10100 | 4291 |
| 562435 | N/A | N/A | TGTATCCCAGTTTTAA | Deoxy, MOE, and cEt | 44 | 10091 | 10106 | 4292 |
| 562436 | N/A | N/A | GATGCATGTATCCCAG | Deoxy, MOE, and cEt | 91 | 10097 | 10112 | 156 |
| 562437 | N/A | N/A | GTTTTAGATGCATGTA | Deoxy, MOE, and cEt | 69 | 10103 | 10118 | 4293 |
| 562438 | N/A | N/A | TACAGTGTTTTAGATG | Deoxy, MOE, and cEt | 28 | 10109 | 10124 | 4294 |
| 562439 | N/A | N/A | GTAAGTTATCTTCCT | Deoxy, MOE, and cEt | 78 | 10138 | 10153 | 157 |
| 562440 | N/A | N/A | TTCCCCGTAAGTTTAT | Deoxy, MOE, and cEt | 33 | 10144 | 10159 | 4295 |

TABLE 29-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 562441 | N/A | N/A | CTGTATTTCCCCGTAA | Deoxy, MOE, and cEt | 55 | 10150 | 10165 | 4296 |
| 562442 | N/A | N/A | CTGTTACTGTATTTCC | Deoxy, MOE, and cEt | 79 | 10156 | 10171 | 158 |
| 562443 | N/A | N/A | TAGTTACTGTTACTGT | Deoxy, MOE, and cEt | 70 | 10162 | 10177 | 4297 |
| 562444 | N/A | N/A | CGTATGTAGTTACTGT | Deoxy, MOE, and cEt | 66 | 10168 | 10183 | 4298 |
| 562445 | N/A | N/A | AATGGGTACAGACTCG | Deoxy, MOE, and cEt | 72 | 10182 | 10197 | 4299 |
| 562446 | N/A | N/A | GCAATTTAATGGGTAC | Deoxy, MOE, and cEt | 59 | 10189 | 10204 | 4300 |
| 562447 | N/A | N/A | GATAGATATGCAATTT | Deoxy, MOE, and cEt | 20 | 10198 | 10213 | 4301 |
| 562448 | N/A | N/A | AAAGGAGATAGATATG | Deoxy, MOE, and cEt | 22 | 10204 | 10219 | 4302 |
| 562449 | N/A | N/A | CCTCCTAAAGGAGATA | Deoxy, MOE, and cEt | 42 | 10210 | 10225 | 4303 |
| 562450 | N/A | N/A | CACCAGCCTCCTAAAG | Deoxy, MOE, and cEt | 37 | 10216 | 10231 | 4304 |
| 544120 | 707 | 726 | AGTTCTTGGTGCTCTTGGCT | 5-10-5 MOE | 83 | 6720 | 6739 | 15 |
| 560990 | 709 | 724 | TTCTTGGTGCTCTTGG | Deoxy, MOE, and cEt | 89 | 6722 | 6737 | 111 |
| 337487 | 804 | 823 | CACTTGTATGTTCACCTCTG | 5-10-5 MOE | 81 | 7389 | 7408 | 28 |
| 561373 | 1197 | 1212 | TTTGTGATCCCAAGTA | Deoxy, MOE, and cEt | 40 | 9772 | 9787 | 4305 |
| 561374 | 1199 | 1214 | GCTTTGTGATCCCAAG | Deoxy, MOE, and cEt | 76 | 9774 | 9789 | 4306 |
| 561375 | 1201 | 1216 | TTGCTTTGTGATCCCA | Deoxy, MOE, and cEt | 82 | 9776 | 9791 | 4307 |
| 561376 | 1203 | 1218 | TTTTGCTTTGTGATCC | Deoxy, MOE, and cEt | 40 | 9778 | 9793 | 4308 |
| 561377 | 1205 | 1220 | CCTTTTGCTTTGTGAT | Deoxy, MOE, and cEt | 38 | 9780 | 9795 | 4309 |
| 561378 | 1207 | 1222 | GTCCTTTTGCTTTGTG | Deoxy, MOE, and cEt | 75 | 9782 | 9797 | 4310 |
| 561379 | 1209 | 1224 | GTGTCCTTTTGCTTTG | Deoxy, MOE, and cEt | 40 | 9784 | 9799 | 4311 |
| 561380 | 1212 | 1227 | GAAGTGTCCTTTTGCT | Deoxy, MOE, and cEt | 23 | 9787 | 9802 | 4312 |
| 561381 | 1214 | 1229 | TTGAAGTGTCCTTTTG | Deoxy, MOE, and cEt | 26 | 9789 | 9804 | 4313 |
| 561382 | 1216 | 1231 | AGTTGAAGTGTCCTTT | Deoxy, MOE, and cEt | 34 | 9791 | 9806 | 4314 |
| 561383 | 1218 | 1233 | ACAGTTGAAGTGTCCT | Deoxy, MOE, and cEt | 27 | 9793 | 9808 | 4315 |
| 561384 | 1220 | 1235 | GGACAGTTGAAGTGTC | Deoxy, MOE, and cEt | 19 | 9795 | 9810 | 4316 |
| 561385 | 1222 | 1237 | CTGGACAGTTGAAGTG | Deoxy, MOE, and cEt | 34 | 9797 | 9812 | 4317 |
| 561386 | 1224 | 1239 | CTCTGGACAGTTGAAG | Deoxy, MOE, and cEt | 19 | 9799 | 9814 | 4318 |
| 561387 | 1226 | 1241 | CCCTCTGGACAGTTGA | Deoxy, MOE, and cEt | 54 | 9801 | 9816 | 4319 |
| 561388 | 1228 | 1243 | AACCCTCTGGACAGTT | Deoxy, MOE, and cEt | 50 | 9803 | 9818 | 4320 |
| 561389 | 1230 | 1245 | ATAACCCTCTGGACAG | Deoxy, MOE, and cEt | 35 | 9805 | 9820 | 4321 |
| 561390 | 1232 | 1247 | GAATAACCCTCTGGAC | Deoxy, MOE, and cEt | 34 | 9807 | 9822 | 4322 |
| 561391 | 1234 | 1249 | CTGAATAACCCTCTGG | Deoxy, MOE, and cEt | 62 | 9809 | 9824 | 4323 |
| 561392 | 1236 | 1251 | TCCTGAATAACCCTCT | Deoxy, MOE, and cEt | 57 | N/A | N/A | 4324 |
| 561393 | 1238 | 1253 | CCTCCTGAATAACCCT | Deoxy, MOE, and cEt | 30 | N/A | N/A | 4325 |
| 561394 | 1246 | 1261 | ACCACCAGCCTCCTGA | Deoxy, MOE, and cEt | 70 | N/A | N/A | 4326 |
| 561395 | 1251 | 1266 | ATGCCACCACCAGCCT | Deoxy, MOE, and cEt | 68 | 10223 | 10238 | 4327 |

TABLE 29-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561396 | 1253 | 1268 | TCATGCCACCACCAGC | Deoxy, MOE, and cEt | 72 | 10225 | 10240 | 4328 |
| 561397 | 1255 | 1270 | CATCATGCCACCACCA | Deoxy, MOE, and cEt | 67 | 10227 | 10242 | 4329 |
| 561398 | 1257 | 1272 | CTCATCATGCCACCAC | Deoxy, MOE, and cEt | 77 | 10229 | 10244 | 172 |
| 561399 | 1259 | 1274 | CACTCATCATGCCACC | Deoxy, MOE, and cEt | 74 | 10231 | 10246 | 2330 |
| 561400 | 1261 | 1276 | CACACTCATCATGCCA | Deoxy, MOE, and cEt | 80 | 10233 | 10248 | 173 |
| 561401 | 1263 | 1278 | TCCACACTCATCATGC | Deoxy, MOE, and cEt | 64 | 10235 | 10250 | 4331 |
| 561402 | 1265 | 1280 | TCTCCACACTCATCAT | Deoxy, MOE, and cEt | 42 | 10237 | 10252 | 4332 |
| 561403 | 1267 | 1282 | TTTCTCCACACTCATC | Deoxy, MOE, and cEt | 47 | 10239 | 10254 | 4333 |
| 561404 | 1269 | 1284 | GTTTTCTCCACACTCA | Deoxy, MOE, and cEt | 77 | 10241 | 10256 | 4334 |
| 561405 | 1272 | 1287 | GTTGTTTTCTCCACAC | Deoxy, MOE, and cEt | 53 | 10244 | 10259 | 4335 |
| 561406 | 1274 | 1289 | AGGTTGTTTTCTCCAC | Deoxy, MOE, and cEt | 67 | 10246 | 10261 | 4336 |
| 561407 | 1276 | 1291 | TTAGGTTGTTTTCTCC | Deoxy, MOE, and cEt | 73 | 10248 | 10263 | 4337 |
| 561408 | 1282 | 1297 | TACCATTTAGGTTGTT | Deoxy, MOE, and cEt | 30 | 10254 | 10269 | 4338 |
| 561409 | 1284 | 1299 | TTTACCATTTAGGTTG | Deoxy, MOE, and cEt | 22 | 10256 | 10271 | 4339 |
| 561410 | 1286 | 1301 | TATTTACCATTTAGGT | Deoxy, MOE, and cEt | 24 | 10258 | 10273 | 4340 |
| 561411 | 1292 | 1307 | TTGTTATATTTACCAT | Deoxy, MOE, and cEt | 41 | 10264 | 10279 | 4341 |
| 561412 | 1294 | 1309 | GTTTGTTATATTTACC | Deoxy, MOE, and cEt | 37 | 10266 | 10281 | 4342 |
| 561413 | 1298 | 1313 | CTTGGTTTGTTATATT | Deoxy, MOE, and cEt | 45 | 10270 | 10285 | 4343 |
| 561414 | 1300 | 1315 | CTCTTGGTTTGTTATA | Deoxy, MOE, and cEt | 73 | 10272 | 10287 | 4344 |
| 561415 | 1302 | 1317 | TGCTCTTGGTTTGTTA | Deoxy, MOE, and cEt | 45 | 10274 | 10289 | 4345 |
| 561416 | 1304 | 1319 | TTTGCTCTTGGTTTGT | Deoxy, MOE, and cEt | 67 | 10276 | 10291 | 4346 |
| 561417 | 1307 | 1322 | GATTTTGCTCTTGGTT | Deoxy, MOE, and cEt | 75 | 10279 | 10294 | 4347 |
| 561418 | 1309 | 1324 | TAGATTTTGCTCTTGG | Deoxy, MOE, and cEt | 87 | 10281 | 10296 | 169 |
| 561419 | 1311 | 1326 | CTTAGATTTTGCTCTT | Deoxy, MOE, and cEt | 64 | 10283 | 10298 | 4348 |
| 561420 | 1313 | 1328 | GGCTTAGATTTTGCTC | Deoxy, MOE, and cEt | 58 | 10285 | 10300 | 4349 |
| 561421 | 1315 | 1330 | CTGGCTTAGATTTTGC | Deoxy, MOE, and cEt | 70 | 10287 | 10302 | 4350 |
| 561422 | 1317 | 1332 | CTCTGGCTTAGATTTT | Deoxy, MOE, and cEt | 38 | 10289 | 10304 | 4351 |
| 561423 | 1319 | 1334 | CTCTCTGGCTTAGATT | Deoxy, MOE, and cEt | 63 | 10291 | 10306 | 4352 |
| 561424 | 1321 | 1336 | TCCTCTCTGGCTTAGA | Deoxy, MOE, and cEt | 76 | 10293 | 10308 | 4353 |
| 561425 | 1323 | 1338 | TCTCCTCTCTGGCTTA | Deoxy, MOE, and cEt | 67 | 10295 | 10310 | 4354 |
| 561426 | 1332 | 1347 | TAATCCTCTTCTCCTC | Deoxy, MOE, and cEt | 50 | 10304 | 10319 | 4355 |
| 561427 | 1334 | 1349 | GATAATCCTCTTCTCC | Deoxy, MOE, and cEt | 36 | 10306 | 10321 | 4356 |
| 561428 | 1336 | 1351 | AAGATAATCCTCTTCT | Deoxy, MOE, and cEt | 43 | 10308 | 10323 | 4357 |
| 561429 | 1338 | 1353 | CCAAGATAATCCTCTT | Deoxy, MOE, and cEt | 59 | 10310 | 10325 | 4358 |
| 561430 | 1340 | 1355 | TTCCAAGATAATCCTC | Deoxy, MOE, and cEt | 65 | 10312 | 10327 | 4359 |
| 561431 | 1342 | 1357 | ACTTCCAAGATAATCC | Deoxy, MOE, and cEt | 74 | 10314 | 10329 | 4360 |

TABLE 29-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561432 | 1344 | 1359 | AGACTTCCAAGATAAT | Deoxy, MOE, and cEt | 52 | 10316 | 10331 | 4361 |
| 561433 | 1346 | 1361 | TGAGACTTCCAAGATA | Deoxy, MOE, and cEt | 49 | 10318 | 10333 | 4362 |
| 561434 | 1348 | 1363 | TTTGAGACTTCCAAGA | Deoxy, MOE, and cEt | 47 | 10320 | 10335 | 4363 |
| 561435 | 1350 | 1365 | ATTTGAGACTTCCAA | Deoxy, MOE, and cEt | 64 | 10322 | 10337 | 4364 |
| 561436 | 1352 | 1367 | CCATTTGAGACTTCC | Deoxy, MOE, and cEt | 84 | 10324 | 10339 | 170 |
| 561437 | 1354 | 1369 | TTCCATTTGAGACTT | Deoxy, MOE, and cEt | 67 | 10326 | 10341 | 4365 |
| 561438 | 1356 | 1371 | CCTTCCATTTGAGAC | Deoxy, MOE, and cEt | 53 | 10328 | 10343 | 4366 |
| 561439 | 1358 | 1373 | AACCTTCCATTTGAG | Deoxy, MOE, and cEt | 37 | 10330 | 10345 | 4367 |
| 561440 | 1360 | 1375 | ATAACCTTCCATTTG | Deoxy, MOE, and cEt | 50 | 10332 | 10347 | 4368 |
| 561441 | 1362 | 1377 | GTATAACCTTCCATTT | Deoxy, MOE, and cEt | 27 | 10334 | 10349 | 4369 |
| 561442 | 1364 | 1379 | GAGTATAACCTTCCAT | Deoxy, MOE, and cEt | 65 | 10336 | 10351 | 4370 |
| 561443 | 1366 | 1381 | TAGAGTATAACCTTCC | Deoxy, MOE, and cEt | 84 | 10338 | 10353 | 171 |
| 561444 | 1368 | 1383 | TATAGAGTATAACCTT | Deoxy, MOE, and cEt | 17 | 10340 | 10355 | 4371 |
| 561445 | 1370 | 1385 | TTTATAGAGTATAACC | Deoxy, MOE, and cEt | 37 | 10342 | 10357 | 4372 |
| 561446 | 1373 | 1388 | GATTTTATAGAGTATA | Deoxy, MOE, and cEt | 28 | 10345 | 10360 | 4373 |
| 561447 | 1375 | 1390 | TTGATTTTATAGAGTA | Deoxy, MOE, and cEt | 21 | 10347 | 10362 | 4374 |
| 561448 | 1377 | 1392 | GGTTGATTTTATAGAG | Deoxy, MOE, and cEt | 28 | 10349 | 10364 | 4375 |
| 561449 | 1379 | 1394 | TTGGTTGATTTTATAG | Deoxy, MOE, and cEt | 22 | 10351 | 10366 | 4376 |
| 567295 | 1452 | 1471 | TAATGTTTAAATTATTGCCT | 5-10-5 MOE | 43 | 10424 | 10443 | 4377 |
| 567296 | 1455 | 1474 | GGTTAATGTTTAAATTATTG | 5-10-5 MOE | 22 | 10427 | 10446 | 4378 |
| 567297 | 1456 | 1475 | AGGTTAATGTTTAAATTATT | 5-10-5 MOE | 0 | 10428 | 10447 | 4379 |
| 567298 | 1457 | 1476 | GAGGTTAATGTTTAAATTAT | 5-10-5 MOE | 0 | 10429 | 10448 | 4380 |
| 567299 | 1458 | 1477 | TGAGGTTAATGTTTAAATTA | 5-10-5 MOE | 6 | 10430 | 10449 | 4381 |
| 567300 | 1460 | 1479 | AATGAGGTTAATGTTTAAAT | 5-10-5 MOE | 14 | 10432 | 10451 | 4382 |
| 567301 | 1461 | 1480 | GAATGAGGTTAATGTTTAAA | 5-10-5 MOE | 5 | 10433 | 10452 | 4383 |
| 567302 | 1462 | 1481 | GGAATGAGGTTAATGTTTAA | 5-10-5 MOE | 27 | 10434 | 10453 | 4384 |
| 567303 | 1463 | 1482 | TGGAATGAGGTTAATGTTTA | 5-10-5 MOE | 32 | 10435 | 10454 | 4385 |
| 567304 | 1464 | 1483 | TTGGAATGAGGTTAATGTTT | 5-10-5 MOE | 37 | 10436 | 10455 | 4386 |
| 567305 | 1465 | 1484 | CTTGGAATGAGGTTAATGTT | 5-10-5 MOE | 25 | 10437 | 10456 | 4387 |
| 567306 | 1468 | 1487 | TAACTTGGAATGAGGTTAAT | 5-10-5 MOE | 29 | 10440 | 10459 | 4388 |
| 567307 | 1469 | 1488 | TTAACTTGGAATGAGGTTAA | 5-10-5 MOE | 44 | 10441 | 10460 | 4389 |
| 337513 | 1470 | 1489 | ATTAACTTGGAATGAGGTTA | 5-10-5 MOE | 52 | 10442 | 10461 | 4390 |
| 567308 | 1471 | 1490 | CATTAACTTGGAATGAGGTT | 5-10-5 MOE | 62 | 10443 | 10462 | 4391 |
| 567309 | 1472 | 1491 | ACATTAACTTGGAATGAGGT | 5-10-5 MOE | 58 | 10444 | 10463 | 4392 |
| 567310 | 1473 | 1492 | CACATTAACTTGGAATGAGG | 5-10-5 MOE | 78 | 10445 | 10464 | 92 |
| 567311 | 1475 | 1494 | ACCACATTAACTTGGAATGA | 5-10-5 MOE | 59 | 10447 | 10466 | 4393 |

TABLE 29-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 567312 | 1476 | 1495 | GACCACATTAACTTGGAATG | 5-10-5 MOE | 57 | 10448 | 10467 | 4394 |
| 337514 | 1477 | 1496 | AGACCACATTAACTTGGAAT | 5-10-5 MOE | 71 | 10449 | 10468 | 4395 |
| 567313 | 1478 | 1497 | TAGACCACATTAACTTGGAA | 5-10-5 MOE | 43 | 10450 | 10469 | 4396 |
| 567314 | 1479 | 1498 | TTAGACCACATTAACTTGGA | 5-10-5 MOE | 59 | 10451 | 10470 | 4397 |
| 567315 | 1480 | 1499 | ATTAGACCACATTAACTTGG | 5-10-5 MOE | 70 | 10452 | 10471 | 4398 |
| 567316 | 1481 | 1500 | TATTAGACCACATTAACTTG | 5-10-5 MOE | 53 | 10453 | 10472 | 4399 |
| 567317 | 1482 | 1501 | TTATTAGACCACATTAACTT | 5-10-5 MOE | 49 | 10454 | 10473 | 4400 |
| 567318 | 1483 | 1502 | ATTATTAGACCACATTAACT | 5-10-5 MOE | 41 | 10455 | 10474 | 4401 |
| 567319 | 1484 | 1503 | GATTATTAGACCACATTAAC | 5-10-5 MOE | 47 | 10456 | 10475 | 4402 |
| 567320 | 1487 | 1506 | CCAGATTATTAGACCACATT | 5-10-5 MOE | 86 | 10459 | 10478 | 93 |
| 567321 | 1489 | 1508 | TACCAGATTATTAGACCACA | 5-10-5 MOE | 85 | 10461 | 10480 | 94 |
| 337516 | 1490 | 1509 | ATACCAGATTATTAGACCAC | 5-10-5 MOE | 77 | 10462 | 10481 | 86 |
| 567322 | 1491 | 1510 | AATACCAGATTATTAGACCA | 5-10-5 MOE | 50 | 10463 | 10482 | 4403 |
| 567323 | 1492 | 1511 | TAATACCAGATTATTAGACC | 5-10-5 MOE | 56 | 10464 | 10483 | 4404 |
| 567324 | 1494 | 1513 | TTTAATACCAGATTATTAGA | 5-10-5 MOE | 9 | 10466 | 10485 | 4405 |
| 567325 | 1495 | 1514 | ATTTAATACCAGATTATTAG | 5-10-5 MOE | 24 | 10467 | 10486 | 4406 |
| 567326 | 1496 | 1515 | GATTTAATACCAGATTATTA | 5-10-5 MOE | 37 | 10468 | 10487 | 4407 |
| 567327 | 1500 | 1519 | TAAGGATTTAATACCAGATT | 5-10-5 MOE | 60 | 10472 | 10491 | 4408 |
| 567328 | 1507 | 1526 | TTTCTCTTAAGGATTTAATA | 5-10-5 MOE | 34 | 10479 | 10498 | 4409 |
| 567329 | 1508 | 1527 | CTTTCTCTTAAGGATTTAAT | 5-10-5 MOE | 46 | 10480 | 10499 | 4410 |
| 567330 | 1509 | 1528 | GCTTTCTCTTAAGGATTTAA | 5-10-5 MOE | 75 | 10481 | 10500 | 95 |
| 567331 | 1510 | 1529 | AGCTTTCTCTTAAGGATTTA | 5-10-5 MOE | 59 | 10482 | 10501 | 4411 |
| 567332 | 1511 | 1530 | AAGCTTTCTCTTAAGGATTT | 5-10-5 MOE | 30 | 10483 | 10502 | 4412 |
| 567333 | 1513 | 1532 | TCAAGCTTTCTCTTAAGGAT | 5-10-5 MOE | 65 | 10485 | 10504 | 4413 |
| 567334 | 1514 | 1533 | CTCAAGCTTTCTCTTAAGGA | 5-10-5 MOE | 77 | 10486 | 10505 | 96 |
| 567335 | 1515 | 1534 | TCTCAAGCTTTCTCTTAAGG | 5-10-5 MOE | 75 | 10487 | 10506 | 97 |
| 567336 | 1516 | 1535 | TTCTCAAGCTTTCTCTTAAG | 5-10-5 MOE | 59 | 10488 | 10507 | 4414 |
| 567337 | 1517 | 1536 | TTTCTCAAGCTTTCTCTTAA | 5-10-5 MOE | 52 | 10489 | 10508 | 4415 |
| 567338 | 1521 | 1540 | TCTATTTCTCAAGCTTTCTC | 5-10-5 MOE | 68 | 10493 | 10512 | 4416 |
| 567339 | 1522 | 1541 | ATCTATTTCTCAAGCTTTCT | 5-10-5 MOE | 71 | 10494 | 10513 | 4417 |
| 567340 | 1523 | 1542 | AATCTATTTCTCAAGCTTTC | 5-10-5 MOE | 74 | 10495 | 10514 | 4418 |
| 567341 | 1524 | 1543 | AAATCTATTTCTCAAGCTTT | 5-10-5 MOE | 63 | 10496 | 10515 | 4419 |
| 567342 | 1525 | 1544 | AAAATCTATTTCTCAAGCTT | 5-10-5 MOE | 54 | 10497 | 10516 | 4420 |
| 567343 | 1532 | 1551 | GATAAAAAAATCTATTTCT | 5-10-5 MOE | 30 | 10504 | 10523 | 4421 |
| 567344 | 1548 | 1567 | TAGACAGTGACTTTAAGATA | 5-10-5 MOE | 37 | 10520 | 10539 | 4422 |
| 567345 | 1549 | 1568 | ATAGACAGTGACTTTAAGAT | 5-10-5 MOE | 29 | 10521 | 10540 | 4423 |

TABLE 29-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 567346 | 1550 | 1569 | AATAGACAGTGACTTTAAGA | 5-10-5 MOE | 48 | 10522 | 10541 | 4424 |
| 567347 | 1551 | 1570 | AAATAGACAGTGACTTTAAG | 5-10-5 MOE | 26 | 10523 | 10542 | 4425 |
| 567348 | 1552 | 1571 | TAAATAGACAGTGACTTTAA | 5-10-5 MOE | 26 | 10524 | 10543 | 4426 |
| 567349 | 1553 | 1572 | TTAAATAGACAGTGACTTTA | 5-10-5 MOE | 50 | 10525 | 10544 | 4427 |
| 567350 | 1554 | 1573 | CTTAAATAGACAGTGACTTT | 5-10-5 MOE | 63 | 10526 | 10545 | 4428 |
| 567351 | 1555 | 1574 | TCTTAAATAGACAGTGACTT | 5-10-5 MOE | 57 | 10527 | 10546 | 4429 |
| 567352 | 1556 | 1575 | ATCTTAAATAGACAGTGACT | 5-10-5 MOE | 69 | 10528 | 10547 | 4430 |
| 567353 | 1557 | 1576 | AATCTTAAATAGACAGTGAC | 5-10-5 MOE | 40 | 10529 | 10548 | 4431 |
| 567354 | 1558 | 1577 | TAATCTTAAATAGACAGTGA | 5-10-5 MOE | 30 | 10530 | 10549 | 4432 |
| 567355 | 1559 | 1578 | TTAATCTTAAATAGACAGTG | 5-10-5 MOE | 25 | 10531 | 10550 | 4433 |
| 567356 | 1560 | 1579 | TTTAATCTTAAATAGACAGT | 5-10-5 MOE | 0 | 10532 | 10551 | 4434 |
| 567357 | 1561 | 1580 | GTTTAATCTTAAATAGACAG | 5-10-5 MOE | 34 | 10533 | 10552 | 4435 |
| 567358 | 1562 | 1581 | TGTTTAATCTTAAATAGACA | 5-10-5 MOE | 5 | 10534 | 10553 | 4436 |
| 567359 | 1563 | 1582 | ATGTTTAATCTTAAATAGAC | 5-10-5 MOE | 0 | 10535 | 10554 | 4437 |
| 567360 | 1567 | 1586 | TTGTATGTTTAATCTTAAAT | 5-10-5 MOE | 0 | 10539 | 10558 | 4438 |
| 567361 | 1568 | 1587 | ATTGTATGTTTAATCTTAAA | 5-10-5 MOE | 8 | 10540 | 10559 | 4439 |
| 567362 | 1569 | 1588 | GATTGTATGTTTAATCTTAA | 5-10-5 MOE | 20 | 10541 | 10560 | 4440 |
| 567363 | 1570 | 1589 | TGATTGTATGTTTAATCTTA | 5-10-5 MOE | 29 | 10542 | 10561 | 4441 |
| 567364 | 1574 | 1593 | TATGTGATTGTATGTTTAAT | 5-10-5 MOE | 7 | 10546 | 10565 | 4442 |
| 567365 | 1576 | 1595 | GTTATGTGATTGTATGTTTA | 5-10-5 MOE | 43 | 10548 | 10567 | 4443 |
| 567366 | 1580 | 1599 | TAAGGTTATGTGATTGTATG | 5-10-5 MOE | 28 | 10552 | 10571 | 4444 |
| 567367 | 1581 | 1600 | TTAAGGTTATGTGATTGTAT | 5-10-5 MOE | 31 | 10553 | 10572 | 4445 |
| 567368 | 1585 | 1604 | TTCTTTAAGGTTATGTGATT | 5-10-5 MOE | 12 | 10557 | 10576 | 4446 |
| 561527 | 1604 | 1619 | GAAATGTAAACGGTAT | Deoxy, MOE, and cEt | 47 | 10576 | 10591 | 4447 |
| 561528 | 1606 | 1621 | GAGAAATGTAAACGGT | Deoxy, MOE, and cEt | 89 | 10578 | 10593 | 174 |
| 561529 | 1608 | 1623 | TTGAGAAATGTAAACG | Deoxy, MOE, and cEt | 55 | 10580 | 10595 | 4448 |
| 561530 | 1611 | 1626 | TGATTGAGAAATGTAA | Deoxy, MOE, and cEt | 18 | 10583 | 10598 | 4449 |
| 561531 | 1613 | 1628 | TTTGATTGAGAAATGT | Deoxy, MOE, and cEt | 30 | 10585 | 10600 | 4450 |
| 561532 | 1619 | 1634 | AAGAATTTTGATTGAG | Deoxy, MOE, and cEt | 53 | 10591 | 10606 | 4451 |
| 561533 | 1621 | 1636 | ATAAGAATTTTGATTG | Deoxy, MOE, and cEt | 29 | 10593 | 10608 | 4452 |
| 561534 | 1632 | 1647 | CAAATAGTATTATAAG | Deoxy, MOE, and cEt | 6 | 10604 | 10619 | 4453 |
| 561535 | 1653 | 1668 | CCCACATCACAAAATT | Deoxy, MOE, and cEt | 70 | 10625 | 10640 | 4454 |
| 561536 | 1657 | 1672 | GATTCCCACATCACAA | Deoxy, MOE, and cEt | 77 | 10629 | 10644 | 4455 |
| 561537 | 1659 | 1674 | TTGATTCCCACATCAC | Deoxy, MOE, and cEt | 78 | 10631 | 10646 | 4456 |
| 561538 | 1661 | 1676 | AATTGATTCCCACATC | Deoxy, MOE, and cEt | 68 | 10633 | 10648 | 4457 |
| 561539 | 1663 | 1678 | AAAATTGATTCCCACA | Deoxy, MOE, and cEt | 72 | 10635 | 10650 | 4458 |

TABLE 29-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561540 | 1665 | 1680 | CTAAAATTGATTCCCA | Deoxy, MOE, and cEt | 54 | 10637 | 10652 | 4459 |
| 561541 | 1668 | 1683 | CATCTAAAATTGATTC | Deoxy, MOE, and cEt | 0 | 10640 | 10655 | 4460 |
| 561542 | 1670 | 1685 | ACCATCTAAAATTGAT | Deoxy, MOE, and cEt | 35 | 10642 | 10657 | 4461 |
| 561543 | 1672 | 1687 | TGACCATCTAAAATTG | Deoxy, MOE, and cEt | 55 | 10644 | 10659 | 4462 |
| 561544 | 1674 | 1689 | TGTGACCATCTAAAAT | Deoxy, MOE, and cEt | 56 | 10646 | 10661 | 4463 |
| 561545 | 1676 | 1691 | ATTGTGACCATCTAAA | Deoxy, MOE, and cEt | 73 | 10648 | 10663 | 4464 |
| 561546 | 1678 | 1693 | AGATTGTGACCATCTA | Deoxy, MOE, and cEt | 67 | 10650 | 10665 | 4465 |
| 561547 | 1680 | 1695 | CTAGATTGTGACCATC | Deoxy, MOE, and cEt | 50 | 10652 | 10667 | 4466 |
| 561548 | 1682 | 1697 | ATCTAGATTGTGACCA | Deoxy, MOE, and cEt | 77 | 10654 | 10669 | 4467 |
| 561549 | 1684 | 1699 | TAATCTAGATTGTGAC | Deoxy, MOE, and cEt | 55 | 10656 | 10671 | 4468 |
| 561550 | 1686 | 1701 | TATAATCTAGATTGTG | Deoxy, MOE, and cEt | 28 | 10658 | 10673 | 4469 |
| 561551 | 1688 | 1703 | ATTATAATCTAGATTG | Deoxy, MOE, and cEt | 52 | 10660 | 10675 | 4470 |
| 561552 | 1690 | 1705 | TGATTATAATCTAGAT | Deoxy, MOE, and cEt | 43 | 10662 | 10677 | 4471 |
| 561553 | 1692 | 1707 | ATTGATTATAATCTAG | Deoxy, MOE, and cEt | 53 | 10664 | 10679 | 4472 |
| 561554 | 1694 | 1709 | CTATTGATTATAATCT | Deoxy, MOE, and cEt | 54 | 10666 | 10681 | 4473 |
| 561555 | 1696 | 1711 | ACCTATTGATTATAAT | Deoxy, MOE, and cEt | 44 | 10668 | 10683 | 4474 |
| 561556 | 1698 | 1713 | TCACCTATTGATTATA | Deoxy, MOE, and cEt | 52 | 10670 | 10685 | 4475 |
| 561557 | 1700 | 1715 | GTTCACCTATTGATTA | Deoxy, MOE, and cEt | 50 | 10672 | 10687 | 4476 |
| 561558 | 1702 | 1717 | AAGTTCACCTATTGAT | Deoxy, MOE, and cEt | 58 | 10674 | 10689 | 4477 |
| 561559 | 1704 | 1719 | ATAAGTTCACCTATTG | Deoxy, MOE, and cEt | 66 | 10676 | 10691 | 4478 |
| 561560 | 1706 | 1721 | TAATAAGTTCACCTAT | Deoxy, MOE, and cEt | 38 | 10678 | 10693 | 4479 |
| 561561 | 1708 | 1723 | TTTAATAAGTTCACCT | Deoxy, MOE, and cEt | 50 | 10680 | 10695 | 4480 |
| 561562 | 1710 | 1725 | TATTTAATAAGTTCAC | Deoxy, MOE, and cEt | 32 | 10682 | 10697 | 4481 |
| 561563 | 1712 | 1727 | GTTATTTAATAAGTTC | Deoxy, MOE, and cEt | 47 | 10684 | 10699 | 4482 |
| 561564 | 1761 | 1776 | CATATGATGCCTTTA | Deoxy, MOE, and cEt | 63 | 10733 | 10748 | 4483 |
| 561565 | 1763 | 1778 | CTCATATGATGCCTTT | Deoxy, MOE, and cEt | 81 | 10735 | 10750 | 175 |
| 561566 | 1765 | 1780 | AGCTCATATGATGCCT | Deoxy, MOE, and cEt | 81 | 10737 | 10752 | 176 |
| 561567 | 1767 | 1782 | TTAGCTCATATGATGC | Deoxy, MOE, and cEt | 84 | 10739 | 10754 | 177 |
| 561568 | 1769 | 1784 | TATTAGCTCATATGAT | Deoxy, MOE, and cEt | 46 | 10741 | 10756 | 4484 |
| 561569 | 1771 | 1786 | GATATTAGCTCATATG | Deoxy, MOE, and cEt | 49 | 10743 | 10758 | 4485 |
| 561570 | 1773 | 1788 | GTGATATTAGCTCATA | Deoxy, MOE, and cEt | 81 | 10745 | 10760 | 4486 |
| 561571 | 1775 | 1790 | TTGTGATATTAGCTCA | Deoxy, MOE, and cEt | 85 | 10747 | 10762 | 178 |
| 561572 | 1777 | 1792 | AGTTGTGATATTAGCT | Deoxy, MOE, and cEt | 68 | 10749 | 10764 | 4487 |
| 561573 | 1779 | 1794 | AAAGTTGTGATATTAG | Deoxy, MOE, and cEt | 45 | 10751 | 10766 | 4488 |
| 561574 | 1781 | 1796 | GGAAAGTTGTGATATT | Deoxy, MOE, and cEt | 27 | 10753 | 10768 | 4489 |
| 561575 | 1783 | 1798 | TGGGAAAGTTGTGATA | Deoxy, MOE, and cEt | 36 | 10755 | 10770 | 4490 |

TABLE 29-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561576 | 1785 | 1800 | ACTGGGAAAGTTGTGA | Deoxy, MOE, and cEt | 83 | 10757 | 10772 | 179 |
| 561577 | 1787 | 1802 | AAACTGGGAAAGTTGT | Deoxy, MOE, and cEt | 56 | 10759 | 10774 | 4491 |
| 561578 | 1789 | 1804 | TTAAACTGGGAAAGTT | Deoxy, MOE, and cEt | 44 | 10761 | 10776 | 4492 |
| 561579 | 1794 | 1809 | GTTTTTAAACTGGGA | Deoxy, MOE, and cEt | 58 | 10766 | 10781 | 4493 |
| 561580 | 1796 | 1811 | TAGTTTTTAAACTGG | Deoxy, MOE, and cEt | 0 | 10768 | 10783 | 4494 |
| 561581 | 1802 | 1817 | GAGTACTAGTTTTTA | Deoxy, MOE, and cEt | 18 | 10774 | 10789 | 4495 |
| 561582 | 1804 | 1819 | AAGAGTACTAGTTTTT | Deoxy, MOE, and cEt | 55 | 10776 | 10791 | 4496 |
| 561583 | 1806 | 1821 | ACAAGAGTACTAGTTT | Deoxy, MOE, and cEt | 51 | 10778 | 10793 | 4497 |
| 561584 | 1808 | 1823 | TAACAAGAGTACTAGT | Deoxy, MOE, and cEt | 53 | 10780 | 10795 | 4498 |
| 561585 | 1810 | 1825 | TTTAACAAGAGTACTA | Deoxy, MOE, and cEt | 48 | 10782 | 10797 | 4499 |
| 561586 | 1812 | 1827 | GTTTTAACAAGAGTAC | Deoxy, MOE, and cEt | 49 | 10784 | 10799 | 4500 |
| 561587 | 1814 | 1829 | GAGTTTTAACAAGAGT | Deoxy, MOE, and cEt | 54 | 10786 | 10801 | 4501 |
| 561588 | 1816 | 1831 | TAGAGTTTTAACAAGA | Deoxy, MOE, and cEt | 9 | 10788 | 10803 | 4502 |
| 561589 | 1819 | 1834 | GTTTAGAGTTTAACA | Deoxy, MOE, and cEt | 24 | 10791 | 10806 | 4503 |
| 561590 | 1822 | 1837 | CAAGTTTAGAGTTTTA | Deoxy, MOE, and cEt | 30 | 10794 | 10809 | 4504 |
| 561591 | 1824 | 1839 | GTCAAGTTTAGAGTTT | Deoxy, MOE, and cEt | 60 | 10796 | 10811 | 4505 |
| 561592 | 1826 | 1841 | TAGTCAAGTTTAGAGT | Deoxy, MOE, and cEt | 56 | 10798 | 10813 | 4506 |
| 561593 | 1828 | 1843 | TTTAGTCAAGTTTAGA | Deoxy, MOE, and cEt | 41 | 10800 | 10815 | 4507 |
| 561594 | 1830 | 1845 | TATTTAGTCAAGTTTA | Deoxy, MOE, and cEt | 14 | 10802 | 10817 | 4508 |
| 561595 | 1832 | 1847 | TGTATTTAGTCAAGTT | Deoxy, MOE, and cEt | 39 | 10804 | 10819 | 4509 |
| 561596 | 1834 | 1849 | TCTGTATTTAGTCAAG | Deoxy, MOE, and cEt | 51 | 10806 | 10821 | 4510 |
| 561597 | 1836 | 1851 | CCTCTGTATTTAGTCA | Deoxy, MOE, and cEt | 72 | 10808 | 10823 | 4511 |
| 561598 | 1838 | 1853 | GTCCTCTGTATTTAGT | Deoxy, MOE, and cEt | 55 | 10810 | 10825 | 4512 |
| 561599 | 1840 | 1855 | CAGTCCTCTGTATTTA | Deoxy, MOE, and cEt | 63 | 10812 | 10827 | 4513 |
| 561600 | 1842 | 1857 | ACCAGTCCTCTGTATT | Deoxy, MOE, and cEt | 66 | 10814 | 10829 | 4514 |
| 561601 | 1844 | 1859 | TTACCAGTCCTCTGTA | Deoxy, MOE, and cEt | 57 | 10816 | 10831 | 4515 |
| 561602 | 1846 | 1861 | AATTACCAGTCCTCTG | Deoxy, MOE, and cEt | 43 | 10818 | 10833 | 4516 |
| 561603 | 1848 | 1863 | ACAATTACCAGTCCTC | Deoxy, MOE, and cEt | 67 | 10820 | 10835 | 4517 |

TABLE 30

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561835 | N/A | N/A | GCAAATTTTCAGTGTT | Deoxy, MOE, and cEt | 49 | 3850 | 3865 | 4518 |
| 561836 | N/A | N/A | CGATTTGTAATTTTCA | Deoxy, MOE, and cEt | 20 | 3874 | 3889 | 4519 |

TABLE 30-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561837 | N/A | N/A | TTTAACCGATTTGTAA | Deoxy, MOE, and cEt | 42 | 3880 | 3895 | 4520 |
| 561838 | N/A | N/A | GTATAATTTAACCGAT | Deoxy, MOE, and cEt | 15 | 3886 | 3901 | 4521 |
| 561839 | N/A | N/A | CTAGATTGTATAATTT | Deoxy, MOE, and cEt | 15 | 3893 | 3908 | 4522 |
| 561840 | N/A | N/A | AGTGTTCTAGATTGTA | Deoxy, MOE, and cEt | 45 | 3899 | 3914 | 4523 |
| 561841 | N/A | N/A | TGACATAGTGTTCTAG | Deoxy, MOE, and cEt | 51 | 3905 | 3920 | 4524 |
| 561842 | N/A | N/A | GTGTAATGACATAGTG | Deoxy, MOE, and cEt | 58 | 3911 | 3926 | 4525 |
| 561843 | N/A | N/A | ACAATAGTGTAATGAC | Deoxy, MOE, and cEt | 12 | 3917 | 3932 | 4526 |
| 561844 | N/A | N/A | GTAATTTACAATAGTG | Deoxy, MOE, and cEt | 18 | 3924 | 3939 | 4527 |
| 561845 | N/A | N/A | CCTTCAGTAATTTACA | Deoxy, MOE, and cEt | 0 | 3930 | 3945 | 4528 |
| 561846 | N/A | N/A | TACTTACCTTCAGTAA | Deoxy, MOE, and cEt | 2 | 3936 | 3951 | 4529 |
| 561847 | N/A | N/A | CTGGAGAATAGTTTTA | Deoxy, MOE, and cEt | 19 | 3969 | 3984 | 4530 |
| 561848 | N/A | N/A | TTAAACACTGGAGAAT | Deoxy, MOE, and cEt | 14 | 3976 | 3991 | 4531 |
| 561849 | N/A | N/A | GCCCAGCATATTTTCA | Deoxy, MOE, and cEt | 22 | 4034 | 4049 | 4532 |
| 561850 | N/A | N/A | GAAAAGCCCAGCATA | Deoxy, MOE, and cEt | 15 | 4040 | 4055 | 4533 |
| 561851 | N/A | N/A | GATTTTCTGAACTTCA | Deoxy, MOE, and cEt | 52 | 4063 | 4078 | 4534 |
| 561852 | N/A | N/A | GTACTATCTCTAAAAT | Deoxy, MOE, and cEt | 6 | 4081 | 4096 | 4535 |
| 561853 | N/A | N/A | TAAATTGTACTATCTC | Deoxy, MOE, and cEt | 13 | 4087 | 4102 | 4536 |
| 561854 | N/A | N/A | CACATATTTTGTCCT | Deoxy, MOE, and cEt | 47 | 4115 | 4130 | 4537 |
| 561855 | N/A | N/A | CTTTCAAATAGCACAT | Deoxy, MOE, and cEt | 31 | 4126 | 4141 | 4538 |
| 561856 | N/A | N/A | GTATGCTTCTTTCAAA | Deoxy, MOE, and cEt | 22 | 4134 | 4149 | 4539 |
| 561857 | N/A | N/A | CCCCTTGTATGCTTCT | Deoxy, MOE, and cEt | 55 | 4140 | 4155 | 4540 |
| 561858 | N/A | N/A | TTCCTTCCCCTTGTAT | Deoxy, MOE, and cEt | 32 | 4146 | 4161 | 4541 |
| 561859 | N/A | N/A | TGGCAATTCCTTCCCC | Deoxy, MOE, and cEt | 43 | 4152 | 4167 | 4542 |
| 561860 | N/A | N/A | GAATATTGGCAATTCC | Deoxy, MOE, and cEt | 52 | 4158 | 4173 | 4543 |
| 561861 | N/A | N/A | CTAATAATGGATTTGA | Deoxy, MOE, and cEt | 0 | 4179 | 4194 | 4544 |
| 561862 | N/A | N/A | CTATCATAATCTAAAT | Deoxy, MOE, and cEt | 0 | 4202 | 4217 | 4545 |
| 561863 | N/A | N/A | GTAACACTATCATAAT | Deoxy, MOE, and cEt | 7 | 4208 | 4223 | 4546 |
| 561864 | N/A | N/A | AATTTCCTGTAACACT | Deoxy, MOE, and cEt | 17 | 4216 | 4231 | 4547 |
| 561865 | N/A | N/A | AAGTTGCTTTCCTCTT | Deoxy, MOE, and cEt | 12 | 4243 | 4258 | 4548 |
| 561866 | N/A | N/A | GGTTATAAGTTGCTTT | Deoxy, MOE, and cEt | 6 | 4249 | 4264 | 4549 |
| 561867 | N/A | N/A | TAGGTTGGTTATAAGT | Deoxy, MOE, and cEt | 10 | 4255 | 4270 | 4550 |
| 561868 | N/A | N/A | AGAGAGTAGGTTGGTT | Deoxy, MOE, and cEt | 10 | 4261 | 4276 | 4551 |
| 561869 | N/A | N/A | GGATATAGAGAGTAGG | Deoxy, MOE, and cEt | 23 | 4267 | 4282 | 4552 |
| 561870 | N/A | N/A | AAGTCTGGATATAGAG | Deoxy, MOE, and cEt | 13 | 4273 | 4288 | 4553 |
| 561871 | N/A | N/A | CTACAAAAGTCTGGAT | Deoxy, MOE, and cEt | 1 | 4279 | 4294 | 4554 |
| 561872 | N/A | N/A | CTTACCTGATTTTCTA | Deoxy, MOE, and cEt | 0 | 4385 | 4400 | 4555 |

TABLE 30-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561873 | N/A | N/A | TACTGACTTACCTGAT | Deoxy, MOE, and cEt | 2 | 4391 | 4406 | 4556 |
| 561874 | N/A | N/A | CCATTAAAATACTGAC | Deoxy, MOE, and cEt | 1 | 4400 | 4415 | 4557 |
| 561875 | N/A | N/A | GGACATACCATTAAAA | Deoxy, MOE, and cEt | 11 | 4407 | 4422 | 4558 |
| 561876 | N/A | N/A | AAGATGGGACATACCA | Deoxy, MOE, and cEt | 38 | 4413 | 4428 | 4559 |
| 561877 | N/A | N/A | GTGTGAAAGATGGGAC | Deoxy, MOE, and cEt | 25 | 4419 | 4434 | 4560 |
| 561878 | N/A | N/A | AGACCTGTGTGAAAGA | Deoxy, MOE, and cEt | 33 | 4425 | 4440 | 4561 |
| 561879 | N/A | N/A | TTTTACAGACCTGTGT | Deoxy, MOE, and cEt | 29 | 4431 | 4446 | 4562 |
| 561880 | N/A | N/A | CAGTGTTTTACAGAC | Deoxy, MOE, and cEt | 40 | 4437 | 4452 | 4563 |
| 561881 | N/A | N/A | TAGGATTCAGTGTTTT | Deoxy, MOE, and cEt | 62 | 4444 | 4459 | 4564 |
| 561882 | N/A | N/A | GTTAAAGCTTGTAAAT | Deoxy, MOE, and cEt | 16 | 4465 | 4480 | 4565 |
| 561883 | N/A | N/A | GATCCAGTTAAAGCTT | Deoxy, MOE, and cEt | 39 | 4471 | 4486 | 4566 |
| 561884 | N/A | N/A | ACTCATGATCCAGTTA | Deoxy, MOE, and cEt | 60 | 4477 | 4492 | 4567 |
| 561885 | N/A | N/A | AATTTTACTCATGATC | Deoxy, MOE, and cEt | 36 | 4483 | 4498 | 4568 |
| 561886 | N/A | N/A | TGTGATAATTTTACTC | Deoxy, MOE, and cEt | 30 | 4489 | 4504 | 4569 |
| 561887 | N/A | N/A | TGCTGATGTGATAATT | Deoxy, MOE, and cEt | 41 | 4495 | 4510 | 4570 |
| 561888 | N/A | N/A | CAGTTATGCTGATGTG | Deoxy, MOE, and cEt | 86 | 4501 | 4516 | 185 |
| 561889 | N/A | N/A | GCAATTTTAACAGTTA | Deoxy, MOE, and cEt | 13 | 4511 | 4526 | 4571 |
| 561890 | N/A | N/A | GAGCCTGCAATTTTAA | Deoxy, MOE, and cEt | 14 | 4517 | 4532 | 4572 |
| 561891 | N/A | N/A | TAGCTTCAGAGCCTGC | Deoxy, MOE, and cEt | 61 | 4525 | 4540 | 4573 |
| 561892 | N/A | N/A | GTTTATTAGCTTCAGA | Deoxy, MOE, and cEt | 45 | 4531 | 4546 | 4574 |
| 561893 | N/A | N/A | CAGGTAGTTTATTAGC | Deoxy, MOE, and cEt | 37 | 4537 | 4552 | 4575 |
| 561894 | N/A | N/A | TAAATGCAGGTAGTTT | Deoxy, MOE, and cEt | 11 | 4543 | 4558 | 4576 |
| 561895 | N/A | N/A | ATGGTTTAAATGCAGG | Deoxy, MOE, and cEt | 53 | 4549 | 4564 | 4577 |
| 561896 | N/A | N/A | TAGAGCCATGGTTTAA | Deoxy, MOE, and cEt | 58 | 4556 | 4571 | 4578 |
| 561897 | N/A | N/A | AAGTTTTAGAGCCATG | Deoxy, MOE, and cEt | 81 | 4562 | 4577 | 186 |
| 561898 | N/A | N/A | TCACACAAAGTTTTAG | Deoxy, MOE, and cEt | 17 | 4569 | 4584 | 4579 |
| 561899 | N/A | N/A | GTGAAGTAATTTATTC | Deoxy, MOE, and cEt | 8 | 4589 | 4604 | 4580 |
| 561900 | N/A | N/A | ACTGAGAGATAAAGGG | Deoxy, MOE, and cEt | 34 | 4605 | 4620 | 4581 |
| 561901 | N/A | N/A | GTATATGTGAGGAAAC | Deoxy, MOE, and cEt | 18 | 4619 | 4634 | 4582 |
| 561902 | N/A | N/A | TTTGTAGTATATGTGA | Deoxy, MOE, and cEt | 3 | 4625 | 4640 | 4583 |
| 561903 | N/A | N/A | ATTATCTTTGTAGTAT | Deoxy, MOE, and cEt | 8 | 4631 | 4646 | 4584 |
| 561904 | N/A | N/A | ATAAGTTCTGTTATTA | Deoxy, MOE, and cEt | 18 | 4643 | 4658 | 4585 |
| 561905 | N/A | N/A | AATCCTATAAGTTCTG | Deoxy, MOE, and cEt | 55 | 4649 | 4664 | 4586 |
| 561906 | N/A | N/A | CTGCTATGAATTAATT | Deoxy, MOE, and cEt | 16 | 4679 | 4694 | 4587 |
| 561907 | N/A | N/A | CATTGGCTGCTATGAA | Deoxy, MOE, and cEt | 48 | 4685 | 4700 | 4588 |
| 561908 | N/A | N/A | AGATGACATTGGCTGC | Deoxy, MOE, and cEt | 71 | 4691 | 4706 | 4589 |

TABLE 30-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561909 | N/A | N/A | TTAGTAAGATGACATT | Deoxy, MOE, and cEt | 0 | 4697 | 4712 | 4590 |
| 561910 | N/A | N/A | GATCTAATTTGAATTT | Deoxy, MOE, and cEt | 7 | 4712 | 4727 | 4591 |
| 561911 | N/A | N/A | TTGAGCAAAGAGAAAC | Deoxy, MOE, and cEt | 6 | 4730 | 4745 | 4592 |
| 561989 | N/A | N/A | GAATGTTGACCTTTAA | Deoxy, MOE, and cEt | 49 | 5356 | 5371 | 4593 |
| 561990 | N/A | N/A | ATTGTTGAATGTTGAC | Deoxy, MOE, and cEt | 57 | 5362 | 5377 | 4594 |
| 561991 | N/A | N/A | TTAATTACATTGTTGA | Deoxy, MOE, and cEt | 0 | 5370 | 5385 | 4595 |
| 561992 | N/A | N/A | TTGTAGATTAATTACA | Deoxy, MOE, and cEt | 18 | 5377 | 5392 | 4596 |
| 561993 | N/A | N/A | TTTACATTGTAGATTA | Deoxy, MOE, and cEt | 3 | 5383 | 5398 | 4597 |
| 561994 | N/A | N/A | CAGATGTTTACATTGT | Deoxy, MOE, and cEt | 71 | 5389 | 5404 | 4598 |
| 561995 | N/A | N/A | CTTCACCAGATGTTTA | Deoxy, MOE, and cEt | 19 | 5395 | 5410 | 4599 |
| 561996 | N/A | N/A | CTGTCACTTCACCAGA | Deoxy, MOE, and cEt | 77 | 5401 | 5416 | 187 |
| 561997 | N/A | N/A | AGTGCTTCCCTCTGTC | Deoxy, MOE, and cEt | 66 | 5412 | 5427 | 4600 |
| 561998 | N/A | N/A | TAAACAAGTGCTTCCC | Deoxy, MOE, and cEt | 62 | 5418 | 5433 | 4601 |
| 561999 | N/A | N/A | TAGCTTTTTTCTAAAC | Deoxy, MOE, and cEt | 0 | 5429 | 5444 | 4602 |
| 562000 | N/A | N/A | CTGACATAGCTTTTTT | Deoxy, MOE, and cEt | 66 | 5435 | 5450 | 4603 |
| 562001 | N/A | N/A | TGGATTCTGACATAGC | Deoxy, MOE, and cEt | 85 | 5441 | 5456 | 188 |
| 562002 | N/A | N/A | AATACATGGATTCTGA | Deoxy, MOE, and cEt | 35 | 5447 | 5462 | 4604 |
| 562003 | N/A | N/A | TATTAGAATACATGGA | Deoxy, MOE, and cEt | 7 | 5453 | 5468 | 4605 |
| 562004 | N/A | N/A | GTACTGCATATTAGAA | Deoxy, MOE, and cEt | 48 | 5461 | 5476 | 4606 |
| 562005 | N/A | N/A | ACTATTGTACTGCATA | Deoxy, MOE, and cEt | 53 | 5467 | 5482 | 4607 |
| 562006 | N/A | N/A | TTTTAAACTATTGTAC | Deoxy, MOE, and cEt | 0 | 5473 | 5488 | 4608 |
| 562007 | N/A | N/A | GAGAGTATTATTAATA | Deoxy, MOE, and cEt | 8 | 5490 | 5505 | 4609 |
| 562008 | N/A | N/A | CTGTTTGAGAGTATTA | Deoxy, MOE, and cEt | 0 | 5496 | 5511 | 4610 |
| 562009 | N/A | N/A | GAATAGCTGTTTGAGA | Deoxy, MOE, and cEt | 34 | 5502 | 5517 | 4611 |
| 562010 | N/A | N/A | AATCCTCTTGAATAGC | Deoxy, MOE, and cEt | 62 | 5511 | 5526 | 4612 |
| 562011 | N/A | N/A | TTTTTGAATCCTCTTG | Deoxy, MOE, and cEt | 50 | 5517 | 5532 | 4613 |
| 562012 | N/A | N/A | GAGTTTATATTATGTT | Deoxy, MOE, and cEt | 5 | 5532 | 5547 | 4614 |
| 562013 | N/A | N/A | GTTTCTCTGAGTTTAT | Deoxy, MOE, and cEt | 58 | 5540 | 5555 | 4615 |
| 562014 | N/A | N/A | TTACCAGTTTCTCTGA | Deoxy, MOE, and cEt | 64 | 5546 | 5561 | 4616 |
| 562015 | N/A | N/A | GATTTTGTTTACCAGT | Deoxy, MOE, and cEt | 68 | 5554 | 5569 | 4617 |
| 562016 | N/A | N/A | GTTTTATATCTCTTGA | Deoxy, MOE, and cEt | 33 | 5574 | 5589 | 4618 |
| 562017 | N/A | N/A | TTGGTAATAATATTTG | Deoxy, MOE, and cEt | 13 | 5589 | 5604 | 4619 |
| 562018 | N/A | N/A | TGGAAATTGGTAATAA | Deoxy, MOE, and cEt | 1 | 5595 | 5610 | 4620 |
| 562019 | N/A | N/A | GTTTAGTGGAAATTGG | Deoxy, MOE, and cEt | 44 | 5601 | 5616 | 4621 |
| 562020 | N/A | N/A | ATGTTTGTTAGTGGA | Deoxy, MOE, and cEt | 47 | 5607 | 5622 | 4622 |
| 562021 | N/A | N/A | CTAACATTATGTTTGT | Deoxy, MOE, and cEt | 0 | 5615 | 5630 | 4623 |

TABLE 30-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 562022 | N/A | N/A | GCACTACTAACATTAT | Deoxy, MOE, and cEt | 42 | 5621 | 5636 | 4624 |
| 562023 | N/A | N/A | TTAGCAGCACTACTAA | Deoxy, MOE, and cEt | 35 | 5627 | 5642 | 4625 |
| 562024 | N/A | N/A | AACCTTTTAGCAGCAC | Deoxy, MOE, and cEt | 76 | 5633 | 5648 | 189 |
| 562025 | N/A | N/A | TTGATAAAAACCTTT | Deoxy, MOE, and cEt | 0 | 5642 | 5657 | 4626 |
| 562026 | N/A | N/A | CAAAAGTAGTTGATAA | Deoxy, MOE, and cEt | 0 | 5651 | 5666 | 4627 |
| 562027 | N/A | N/A | GGAAACCAAAAGTAGT | Deoxy, MOE, and cEt | 28 | 5657 | 5672 | 4628 |
| 562028 | N/A | N/A | GAAAGTATGGAAACCA | Deoxy, MOE, and cEt | 52 | 5665 | 5680 | 4629 |
| 562029 | N/A | N/A | ACATCATAAGAAGGAA | Deoxy, MOE, and cEt | 8 | 5678 | 5693 | 4630 |
| 562030 | N/A | N/A | TCATAGTAAAAGATAT | Deoxy, MOE, and cEt | 0 | 5718 | 5733 | 4631 |
| 562031 | N/A | N/A | TCATTTAATCATAGTA | Deoxy, MOE, and cEt | 7 | 5726 | 5741 | 4632 |
| 562032 | N/A | N/A | GCAGGTTCATTTAATC | Deoxy, MOE, and cEt | 56 | 5732 | 5747 | 4633 |
| 562033 | N/A | N/A | GTAACATTTGCTTTG | Deoxy, MOE, and cEt | 44 | 5752 | 5767 | 4634 |
| 562034 | N/A | N/A | ATATTACTATAGTAAC | Deoxy, MOE, and cEt | 4 | 5763 | 5778 | 4635 |
| 562035 | N/A | N/A | CAATGTATATTACTAT | Deoxy, MOE, and cEt | 19 | 5769 | 5784 | 4636 |
| 562036 | N/A | N/A | TAGACACAATGTATAT | Deoxy, MOE, and cEt | 17 | 5775 | 5790 | 4637 |
| 562037 | N/A | N/A | GGTTTCTTCACACATT | Deoxy, MOE, and cEt | 63 | 5799 | 5814 | 4638 |
| 562038 | N/A | N/A | CTCAGAAATTCATTGT | Deoxy, MOE, and cEt | 36 | 5818 | 5833 | 4639 |
| 562039 | N/A | N/A | CTTCTTCCAACTCAGA | Deoxy, MOE, and cEt | 56 | 5828 | 5843 | 4640 |
| 562040 | N/A | N/A | CTAACTCTTCTTCCAA | Deoxy, MOE, and cEt | 39 | 5834 | 5849 | 4641 |
| 562041 | N/A | N/A | AATGATCTAACTCTTC | Deoxy, MOE, and cEt | 33 | 5840 | 5855 | 4642 |
| 562042 | N/A | N/A | GAAAGTTAAATGATCT | Deoxy, MOE, and cEt | 3 | 5848 | 5863 | 4643 |
| 562043 | N/A | N/A | ATCTTAAAGTTACTTA | Deoxy, MOE, and cEt | 56 | 5900 | 5915 | 4644 |
| 562044 | N/A | N/A | TATGTGATCTTAAAGT | Deoxy, MOE, and cEt | 5 | 5906 | 5921 | 4645 |
| 562045 | N/A | N/A | AGTAACTATGTGATCT | Deoxy, MOE, and cEt | 60 | 5912 | 5927 | 4646 |
| 562046 | N/A | N/A | CTACTAAGTAACTATG | Deoxy, MOE, and cEt | 0 | 5918 | 5933 | 4647 |
| 562047 | N/A | N/A | TCTTTTCTACTAAGTA | Deoxy, MOE, and cEt | 18 | 5924 | 5939 | 4648 |
| 562048 | N/A | N/A | TATTACTCTTTTCTAC | Deoxy, MOE, and cEt | 3 | 5930 | 5945 | 4649 |
| 562049 | N/A | N/A | GCTGGGTATTACTCTT | Deoxy, MOE, and cEt | 76 | 5936 | 5951 | 4650 |
| 562050 | N/A | N/A | TTGCTTGCTGGGTATT | Deoxy, MOE, and cEt | 77 | 5942 | 5957 | 190 |
| 562051 | N/A | N/A | TAAAGTTTGCTTGCTG | Deoxy, MOE, and cEt | 58 | 5948 | 5963 | 4651 |
| 562052 | N/A | N/A | CTATTGTAAAGTTTGC | Deoxy, MOE, and cEt | 16 | 5954 | 5969 | 4652 |
| 562053 | N/A | N/A | AAGGATCTATTGTAAA | Deoxy, MOE, and cEt | 5 | 5960 | 5975 | 4653 |
| 562054 | N/A | N/A | CTTATTTAAAAGGATC | Deoxy, MOE, and cEt | 0 | 5969 | 5984 | 4654 |
| 562055 | N/A | N/A | TAGGACCTTATTTAAA | Deoxy, MOE, and cEt | 0 | 5975 | 5990 | 4655 |
| 562056 | N/A | N/A | ATTTCCTAGGACCTTA | Deoxy, MOE, and cEt | 10 | 5981 | 5996 | 4656 |
| 562057 | N/A | N/A | CATGAATGATATTTCC | Deoxy, MOE, and cEt | 39 | 5991 | 6006 | 4657 |

TABLE 30-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 562058 | N/A | N/A | TGCTGGCATGAATGAT | Deoxy, MOE, and cEt | 62 | 5997 | 6012 | 4658 |
| 562059 | N/A | N/A | TTTTGATGCTGGCATG | Deoxy, MOE, and cEt | 74 | 6003 | 6018 | 4659 |
| 562060 | N/A | N/A | TTAGTTTTTGATGCT | Deoxy, MOE, and cEt | 25 | 6009 | 6024 | 4660 |
| 562061 | N/A | N/A | GCATTATTAGTGTTAG | Deoxy, MOE, and cEt | 44 | 6021 | 6036 | 4661 |
| 562062 | N/A | N/A | TATCTTGCATTATTAG | Deoxy, MOE, and cEt | 35 | 6027 | 6042 | 4662 |
| 562063 | N/A | N/A | ATATAATATCTTGCAT | Deoxy, MOE, and cEt | 0 | 6033 | 6048 | 4663 |
| 562064 | N/A | N/A | CATTGACAGTAAGAAA | Deoxy, MOE, and cEt | 0 | 6057 | 6072 | 4664 |
| 562065 | N/A | N/A | AGTTTTTCTCATTGAC | Deoxy, MOE, and cEt | 62 | 6066 | 6081 | 4665 |
| 562143 | N/A | N/A | ATGGATATCTCTTAAC | Deoxy, MOE, and cEt | 18 | 6869 | 6884 | 4666 |
| 562144 | N/A | N/A | TATTTGATGGATATCT | Deoxy, MOE, and cEt | 35 | 6875 | 6890 | 4667 |
| 562145 | N/A | N/A | ACATTGTATTTGATGG | Deoxy, MOE, and cEt | 41 | 6881 | 6896 | 4668 |
| 562146 | N/A | N/A | GTTGATACATTGTATT | Deoxy, MOE, and cEt | 8 | 6887 | 6902 | 4669 |
| 562147 | N/A | N/A | GTTTAGGTTGATACAT | Deoxy, MOE, and cEt | 35 | 6893 | 6908 | 4670 |
| 562148 | N/A | N/A | CATCCAGTTTAGGTTG | Deoxy, MOE, and cEt | 59 | 6899 | 6914 | 4671 |
| 562149 | N/A | N/A | CCCCAGCATCCAGTTT | Deoxy, MOE, and cEt | 37 | 6905 | 6920 | 4672 |
| 562150 | N/A | N/A | AAAGAACCCCAGCATC | Deoxy, MOE, and cEt | 35 | 6911 | 6926 | 4673 |
| 562151 | N/A | N/A | GTGTAAAAAGAACCCC | Deoxy, MOE, and cEt | 33 | 6917 | 6932 | 4674 |
| 562152 | N/A | N/A | TATAGGGTGTAAAAAG | Deoxy, MOE, and cEt | 0 | 6923 | 6938 | 4675 |
| 562153 | N/A | N/A | GTCTTTTATAGGGTGT | Deoxy, MOE, and cEt | 75 | 6929 | 6944 | 191 |
| 562154 | N/A | N/A | AGGTATGTCTTTTATA | Deoxy, MOE, and cEt | 21 | 6935 | 6950 | 4676 |
| 562155 | N/A | N/A | TTGTCTTAGGTATGTC | Deoxy, MOE, and cEt | 84 | 6942 | 6957 | 192 |
| 562156 | N/A | N/A | CTCTGATTGTCTTAGG | Deoxy, MOE, and cEt | 77 | 6948 | 6963 | 193 |
| 562157 | N/A | N/A | GTATTCTCTGATTGT | Deoxy, MOE, and cEt | 77 | 6954 | 6969 | 194 |
| 562158 | N/A | N/A | AGTCCATATTTGTATT | Deoxy, MOE, and cEt | 49 | 6965 | 6980 | 4677 |
| 562159 | N/A | N/A | TAATCAAGTCCATATT | Deoxy, MOE, and cEt | 19 | 6971 | 6986 | 4678 |
| 562160 | N/A | N/A | ATCTAATAATCAAGTC | Deoxy, MOE, and cEt | 5 | 6977 | 6992 | 4679 |
| 562161 | N/A | N/A | CCTTCTATATTATCTA | Deoxy, MOE, and cEt | 38 | 6988 | 7003 | 4680 |
| 562162 | N/A | N/A | TAATAAACCTTCTATA | Deoxy, MOE, and cEt | 8 | 6995 | 7010 | 4681 |
| 562163 | N/A | N/A | GATCACATCTAAGAAA | Deoxy, MOE, and cEt | 25 | 7013 | 7028 | 4682 |
| 562164 | N/A | N/A | TACCATGATCACATCT | Deoxy, MOE, and cEt | 66 | 7019 | 7034 | 4683 |
| 562165 | N/A | N/A | CTGCAATACCATGATC | Deoxy, MOE, and cEt | 54 | 7025 | 7040 | 4684 |
| 562166 | N/A | N/A | GTTCTCCTTTAAAACT | Deoxy, MOE, and cEt | 0 | 7039 | 7054 | 4685 |
| 562167 | N/A | N/A | GAGATTGTTCTCCTTT | Deoxy, MOE, and cEt | 7 | 7045 | 7060 | 4686 |
| 562168 | N/A | N/A | AAACAGGAGATTGTTC | Deoxy, MOE, and cEt | 6 | 7051 | 7066 | 4687 |
| 562169 | N/A | N/A | TCTCTTAAACAGGAGA | Deoxy, MOE, and cEt | 1 | 7057 | 7072 | 4688 |
| 562170 | N/A | N/A | CATGTATCTCTTAAAC | Deoxy, MOE, and cEt | 40 | 7063 | 7078 | 4689 |

TABLE 30-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 562171 | N/A | N/A | CGTAAATATTTCAGCA | Deoxy, MOE, and cEt | 30 | 7077 | 7092 | 4690 |
| 562172 | N/A | N/A | TAACTCCGTAAATATT | Deoxy, MOE, and cEt | 0 | 7083 | 7098 | 4691 |
| 562173 | N/A | N/A | GACCTTTAACTCCGTA | Deoxy, MOE, and cEt | 68 | 7089 | 7104 | 4692 |
| 562174 | N/A | N/A | TCCAGTGACCTTTAAC | Deoxy, MOE, and cEt | 6 | 7095 | 7110 | 4693 |
| 562175 | N/A | N/A | CACCAGTCTGGAGTCC | Deoxy, MOE, and cEt | 52 | 7108 | 7123 | 4694 |
| 562176 | N/A | N/A | TTCTATCACCAGTCTG | Deoxy, MOE, and cEt | 67 | 7114 | 7129 | 4695 |
| 562177 | N/A | N/A | ATCTTACCAAACTATT | Deoxy, MOE, and cEt | 23 | 7171 | 7186 | 4696 |
| 562178 | N/A | N/A | AGAATCATCTTACCAA | Deoxy, MOE, and cEt | 55 | 7177 | 7192 | 4697 |
| 562179 | N/A | N/A | GAATGTAAGAATCATC | Deoxy, MOE, and cEt | 0 | 7184 | 7199 | 4698 |
| 562180 | N/A | N/A | GTGTTATTTAAGAATG | Deoxy, MOE, and cEt | 0 | 7195 | 7210 | 4699 |
| 562181 | N/A | N/A | TTTTTCTTAGATGGCG | Deoxy, MOE, and cEt | 82 | 7210 | 7225 | 195 |
| 562182 | N/A | N/A | GTTTATGTTAAAGCAT | Deoxy, MOE, and cEt | 8 | 7225 | 7240 | 4700 |
| 562183 | N/A | N/A | AGTAATGTTTATGTTA | Deoxy, MOE, and cEt | 4 | 7231 | 7246 | 4701 |
| 562184 | N/A | N/A | GTAGCATTTTTCAGT | Deoxy, MOE, and cEt | 58 | 7244 | 7259 | 4702 |
| 562185 | N/A | N/A | GCAAATGTAGCATTTT | Deoxy, MOE, and cEt | 61 | 7250 | 7265 | 4703 |
| 562186 | N/A | N/A | GTTGTGGCAAATGTAG | Deoxy, MOE, and cEt | 32 | 7256 | 7271 | 4704 |
| 562187 | N/A | N/A | TATGAAGTTGTGGCAA | Deoxy, MOE, and cEt | 54 | 7262 | 7277 | 4705 |
| 562188 | N/A | N/A | GATTTCACTTGACATT | Deoxy, MOE, and cEt | 19 | 7279 | 7294 | 4706 |
| 562189 | N/A | N/A | GCTTGAGATTTCACTT | Deoxy, MOE, and cEt | 42 | 7285 | 7300 | 4707 |
| 562190 | N/A | N/A | TTTGGAGCTTGAGATT | Deoxy, MOE, and cEt | 22 | 7291 | 7306 | 4708 |
| 562191 | N/A | N/A | AATATCTTTGGAGCTT | Deoxy, MOE, and cEt | 36 | 7297 | 7312 | 4709 |
| 562192 | N/A | N/A | AGGAATAATATCTTTG | Deoxy, MOE, and cEt | 5 | 7303 | 7318 | 4710 |
| 562193 | N/A | N/A | ATTTAGTAATAGGAAT | Deoxy, MOE, and cEt | 5 | 7313 | 7328 | 4711 |
| 562194 | N/A | N/A | CATCAGATTTAGTAAT | Deoxy, MOE, and cEt | 0 | 7319 | 7334 | 4712 |
| 562195 | N/A | N/A | GTTATTACATCAGATT | Deoxy, MOE, and cEt | 23 | 7326 | 7341 | 4713 |
| 562196 | N/A | N/A | GCCTAGAATCAATAAA | Deoxy, MOE, and cEt | 8 | 7344 | 7359 | 4714 |
| 562197 | N/A | N/A | AGGAATGCCTAGAATC | Deoxy, MOE, and cEt | 2 | 7350 | 7365 | 4715 |
| 562198 | N/A | N/A | TTCAGCAGGAATGCCT | Deoxy, MOE, and cEt | 46 | 7356 | 7371 | 4716 |
| 562199 | N/A | N/A | TTACCTGATATAACAT | Deoxy, MOE, and cEt | 41 | 7460 | 7475 | 4717 |
| 562200 | N/A | N/A | CAGGTTTTACCTGATA | Deoxy, MOE, and cEt | 31 | 7466 | 7481 | 4718 |
| 562201 | N/A | N/A | CTTAGACAGGTTTTAC | Deoxy, MOE, and cEt | 41 | 7472 | 7487 | 4719 |
| 562202 | N/A | N/A | ATTCTCCTTAGACAGG | Deoxy, MOE, and cEt | 37 | 7478 | 7493 | 4720 |
| 562203 | N/A | N/A | CTGTCTATTCTCCTTA | Deoxy, MOE, and cEt | 53 | 7484 | 7499 | 4721 |
| 562204 | N/A | N/A | TAACTACTGTCTATTC | Deoxy, MOE, and cEt | 5 | 7490 | 7505 | 4722 |
| 562205 | N/A | N/A | TTGAACTAACTACTGT | Deoxy, MOE, and cEt | 3 | 7496 | 7511 | 4723 |
| 562206 | N/A | N/A | AGTAAGTTGAACTAAC | Deoxy, MOE, and cEt | 11 | 7502 | 7517 | 4724 |

TABLE 30-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 562207 | N/A | N/A | GTAATGAGTAAGTTGA | Deoxy, MOE, and cEt | 37 | 7508 | 7523 | 4725 |
| 562208 | N/A | N/A | TAATCTTCCTAATACG | Deoxy, MOE, and cEt | 5 | 7523 | 7538 | 4726 |
| 562209 | N/A | N/A | ACCAGGTTAATCTTCC | Deoxy, MOE, and cEt | 71 | 7530 | 7545 | 4727 |
| 562210 | N/A | N/A | ATGATAACCAGGTTAA | Deoxy, MOE, and cEt | 42 | 7536 | 7551 | 4728 |
| 562211 | N/A | N/A | CGAATACTCATATATA | Deoxy, MOE, and cEt | 20 | 7576 | 7591 | 4729 |
| 562212 | N/A | N/A | TTTATACGAATACTCA | Deoxy, MOE, and cEt | 17 | 7582 | 7597 | 4730 |
| 562213 | N/A | N/A | ATTATATTTATACGAA | Deoxy, MOE, and cEt | 0 | 7588 | 7603 | 4731 |
| 562214 | N/A | N/A | GGTAAAAGTATTATAT | Deoxy, MOE, and cEt | 0 | 7597 | 7612 | 4732 |
| 562215 | N/A | N/A | GAGAATATTGAGTAAA | Deoxy, MOE, and cEt | 9 | 7624 | 7639 | 4733 |
| 562216 | N/A | N/A | CAGATTATTTTAGAGG | Deoxy, MOE, and cEt | 16 | 7645 | 7660 | 4734 |
| 562217 | N/A | N/A | TCACTTCAGATTATTT | Deoxy, MOE, and cEt | 34 | 7651 | 7666 | 4735 |
| 562218 | N/A | N/A | TAATAGTCACTTCAGA | Deoxy, MOE, and cEt | 33 | 7657 | 7672 | 4736 |
| 562219 | N/A | N/A | TATTGATAATAGTCAC | Deoxy, MOE, and cEt | 1 | 7663 | 7678 | 4737 |
| 562297 | N/A | N/A | TACTATTTGTAATCAA | Deoxy, MOE, and cEt | 0 | 8493 | 8508 | 4738 |
| 562298 | N/A | N/A | CTTGCTTATTTTACTA | Deoxy, MOE, and cEt | 24 | 8504 | 8519 | 4739 |
| 562299 | N/A | N/A | CATCTGTTATTTTATC | Deoxy, MOE, and cEt | 0 | 8519 | 8534 | 4740 |
| 562300 | N/A | N/A | ATGTGCTTTTTGGATT | Deoxy, MOE, and cEt | 20 | 8540 | 8555 | 4741 |
| 562301 | N/A | N/A | GGATTTTGTATGTGC | Deoxy, MOE, and cEt | 64 | 8550 | 8565 | 4742 |
| 562302 | N/A | N/A | CATCATTCATGGATTT | Deoxy, MOE, and cEt | 55 | 8560 | 8575 | 4743 |
| 562303 | N/A | N/A | CTTAGACATCATTCAT | Deoxy, MOE, and cEt | 32 | 8566 | 8581 | 4744 |
| 562304 | N/A | N/A | TGAGTACTTAGACATC | Deoxy, MOE, and cEt | 58 | 8572 | 8587 | 4745 |
| 562305 | N/A | N/A | TATAAGTGAGTACTTA | Deoxy, MOE, and cEt | 3 | 8578 | 8593 | 4746 |
| 562306 | N/A | N/A | CTACTTTATAAGTGAG | Deoxy, MOE, and cEt | 0 | 8584 | 8599 | 4747 |
| 562307 | N/A | N/A | TGAATGTCTTCTACTT | Deoxy, MOE, and cEt | 42 | 8594 | 8609 | 4748 |
| 562308 | N/A | N/A | TATAATAATGAATGTC | Deoxy, MOE, and cEt | 2 | 8602 | 8617 | 4749 |
| 562309 | N/A | N/A | GTACTGAGCATTTAAA | Deoxy, MOE, and cEt | 24 | 8625 | 8640 | 4750 |
| 562310 | N/A | N/A | CAAATAGTACTGAGCA | Deoxy, MOE, and cEt | 48 | 8631 | 8646 | 4751 |
| 562311 | N/A | N/A | AATGGTCAAATAGTAC | Deoxy, MOE, and cEt | 0 | 8637 | 8652 | 4752 |
| 562312 | N/A | N/A | GTAGTTTGAATACAAA | Deoxy, MOE, and cEt | 9 | 8660 | 8675 | 4753 |
| 562313 | N/A | N/A | TCACTGGTAGTTTGAA | Deoxy, MOE, and cEt | 56 | 8666 | 8681 | 4754 |
| 562314 | N/A | N/A | GGGCTTTCACTGGTAG | Deoxy, MOE, and cEt | 70 | 8672 | 8687 | 196 |
| 562315 | N/A | N/A | TAGGTAGGGCTTTCAC | Deoxy, MOE, and cEt | 50 | 8678 | 8693 | 4755 |
| 562316 | N/A | N/A | ACCTTCTAGGTAGGGC | Deoxy, MOE, and cEt | 47 | 8684 | 8699 | 4756 |
| 562317 | N/A | N/A | GAGTATACCTTCTAGG | Deoxy, MOE, and cEt | 38 | 8690 | 8705 | 4757 |
| 562318 | N/A | N/A | ATCACTGAGTATACCT | Deoxy, MOE, and cEt | 61 | 8696 | 8711 | 4758 |
| 562319 | N/A | N/A | AAACTTATCACTGAGT | Deoxy, MOE, and cEt | 0 | 8702 | 8717 | 4759 |

TABLE 30-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 562320 | N/A | N/A | GCTACAAAACTTATCA | Deoxy, MOE, and cEt | 8 | 8708 | 8723 | 4760 |
| 562321 | N/A | N/A | TTTGGAGCTACAAAAC | Deoxy, MOE, and cEt | 0 | 8714 | 8729 | 4761 |
| 562322 | N/A | N/A | AGAAGATTTGGAGCTA | Deoxy, MOE, and cEt | 24 | 8720 | 8735 | 4762 |
| 562323 | N/A | N/A | ACTATTAGAAGATTTG | Deoxy, MOE, and cEt | 0 | 8726 | 8741 | 4763 |
| 562324 | N/A | N/A | ACACTCACTATTAGAA | Deoxy, MOE, and cEt | 0 | 8732 | 8747 | 4764 |
| 562325 | N/A | N/A | AGCCTTTTATTTTGGG | Deoxy, MOE, and cEt | 37 | 8751 | 8766 | 4765 |
| 562326 | N/A | N/A | CCTGTCAGCCTTTTAT | Deoxy, MOE, and cEt | 0 | 8757 | 8772 | 4766 |
| 562327 | N/A | N/A | GACTTACCTGTCAGCC | Deoxy, MOE, and cEt | 47 | 8763 | 8778 | 4767 |
| 562328 | N/A | N/A | ATTCTCGACTTACCTG | Deoxy, MOE, and cEt | 12 | 8769 | 8784 | 4768 |
| 562329 | N/A | N/A | GTGAGTATTCTCGACT | Deoxy, MOE, and cEt | 25 | 8775 | 8790 | 4769 |
| 562330 | N/A | N/A | AATTAAGTGAGTATTC | Deoxy, MOE, and cEt | 0 | 8781 | 8796 | 4770 |
| 562331 | N/A | N/A | TACCAGAATTAAGTGA | Deoxy, MOE, and cEt | 0 | 8787 | 8802 | 4771 |
| 562332 | N/A | N/A | GCTTTCTTACCAGAAT | Deoxy, MOE, and cEt | 23 | 8794 | 8809 | 4772 |
| 562333 | N/A | N/A | TGGGTTGCTTTCTTAC | Deoxy, MOE, and cEt | 0 | 8800 | 8815 | 4773 |
| 562334 | N/A | N/A | TACAAGTACAAATGGG | Deoxy, MOE, and cEt | 36 | 8812 | 8827 | 4774 |
| 562335 | N/A | N/A | GGTAAATACAAGTACA | Deoxy, MOE, and cEt | 19 | 8818 | 8833 | 4775 |
| 562336 | N/A | N/A | ATTGCTGGTAAATACA | Deoxy, MOE, and cEt | 13 | 8824 | 8839 | 4776 |
| 562337 | N/A | N/A | TTAAGGATTGCTGGTA | Deoxy, MOE, and cEt | 43 | 8830 | 8845 | 4777 |
| 562338 | N/A | N/A | GCTTCATTTTAAGGAT | Deoxy, MOE, and cEt | 12 | 8838 | 8853 | 4778 |
| 562339 | N/A | N/A | GTAGGAAGCTTCATTT | Deoxy, MOE, and cEt | 23 | 8845 | 8860 | 4779 |
| 562340 | N/A | N/A | GAGTTAGTAGGAAGCT | Deoxy, MOE, and cEt | 58 | 8851 | 8866 | 4780 |
| 562341 | N/A | N/A | GCTATTGAGTTAGTAG | Deoxy, MOE, and cEt | 21 | 8857 | 8872 | 4781 |
| 562342 | N/A | N/A | CTTATTGCTATTGAGT | Deoxy, MOE, and cEt | 34 | 8863 | 8878 | 4782 |
| 562343 | N/A | N/A | TATTGTCTTATTGCTA | Deoxy, MOE, and cEt | 17 | 8869 | 8884 | 4783 |
| 562344 | N/A | N/A | ATTCACTATTGTCTTA | Deoxy, MOE, and cEt | 22 | 8875 | 8890 | 4784 |
| 562345 | N/A | N/A | ATCACAATCCTTTTTA | Deoxy, MOE, and cEt | 18 | 8925 | 8940 | 4785 |
| 562346 | N/A | N/A | TTCTTCATCACAATCC | Deoxy, MOE, and cEt | 43 | 8931 | 8946 | 4786 |
| 562347 | N/A | N/A | AGATTGTTCTTCATCA | Deoxy, MOE, and cEt | 35 | 8937 | 8952 | 4787 |
| 562348 | N/A | N/A | TATAAATAGATTGTTC | Deoxy, MOE, and cEt | 10 | 8944 | 8959 | 4788 |
| 562349 | N/A | N/A | GGTTCTTAATAACTTT | Deoxy, MOE, and cEt | 31 | 9011 | 9026 | 4789 |
| 562350 | N/A | N/A | AAGCATGGTTCTTAAT | Deoxy, MOE, and cEt | 12 | 9017 | 9032 | 4790 |
| 562351 | N/A | N/A | CTTTGTAGAAAAGAC | Deoxy, MOE, and cEt | 0 | 9066 | 9081 | 4791 |
| 562352 | N/A | N/A | TATGCTTTCTTTGTAG | Deoxy, MOE, and cEt | 26 | 9074 | 9089 | 4792 |
| 562353 | N/A | N/A | CTTAATGTATGCTTTC | Deoxy, MOE, and cEt | 55 | 9081 | 9096 | 4793 |
| 562354 | N/A | N/A | GTATTTGCTTAATGTA | Deoxy, MOE, and cEt | 0 | 9088 | 9103 | 4794 |
| 562355 | N/A | N/A | CCTTTGGTATTTGCTT | Deoxy, MOE, and cEt | 54 | 9094 | 9109 | 4795 |

TABLE 30-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 562356 | N/A | N/A | ACCTGGCCTTTGGTAT | Deoxy, MOE, and cEt | 0 | 9100 | 9115 | 4796 |
| 562357 | N/A | N/A | ATGTAAACCTGGCCTT | Deoxy, MOE, and cEt | 1 | 9106 | 9121 | 4797 |
| 562358 | N/A | N/A | CTTCAAATGTAAACCT | Deoxy, MOE, and cEt | 0 | 9112 | 9127 | 4798 |
| 562359 | N/A | N/A | GTAATAATAATGTCAC | Deoxy, MOE, and cEt | 0 | 9131 | 9146 | 4799 |
| 562360 | N/A | N/A | AGACTTGAGTAATAAT | Deoxy, MOE, and cEt | 0 | 9139 | 9154 | 4800 |
| 562361 | N/A | N/A | TCCTAGAGACTTGAGT | Deoxy, MOE, and cEt | 25 | 9145 | 9160 | 4801 |
| 562362 | N/A | N/A | AAGTATTCCTAGAGAC | Deoxy, MOE, and cEt | 28 | 9151 | 9166 | 4802 |
| 562363 | N/A | N/A | TGTGTTAAGTATTCCT | Deoxy, MOE, and cEt | 50 | 9157 | 9172 | 4803 |
| 562364 | N/A | N/A | AAGAGATGTGTTAAGT | Deoxy, MOE, and cEt | 21 | 9163 | 9178 | 4804 |
| 562365 | N/A | N/A | ACAGTCAAGAGATGTG | Deoxy, MOE, and cEt | 74 | 9169 | 9184 | 197 |
| 562366 | N/A | N/A | CCATATACAGTCAAGA | Deoxy, MOE, and cEt | 49 | 9175 | 9190 | 4805 |
| 562367 | N/A | N/A | TAACATCCATATACAG | Deoxy, MOE, and cEt | 16 | 9181 | 9196 | 4806 |
| 562368 | N/A | N/A | CTATTTATTAACATCC | Deoxy, MOE, and cEt | 2 | 9189 | 9204 | 4807 |
| 562369 | N/A | N/A | TGTCAGCTATTTATTA | Deoxy, MOE, and cEt | 22 | 9195 | 9210 | 4808 |
| 562370 | N/A | N/A | CTTTACTGTCAGCTAT | Deoxy, MOE, and cEt | 56 | 9201 | 9216 | 4809 |
| 562371 | N/A | N/A | GATAAACTTTACTGTC | Deoxy, MOE, and cEt | 37 | 9207 | 9222 | 4810 |
| 562372 | N/A | N/A | CTTTATATGGATAAAC | Deoxy, MOE, and cEt | 31 | 9216 | 9231 | 4811 |
| 562373 | N/A | N/A | GCAAGTCTTTATATGG | Deoxy, MOE, and cEt | 62 | 9222 | 9237 | 4812 |
| 560990 | 709 | 724 | TTCTTGGTGCTCTTGG | Deoxy, MOE, and cEt | 74 | 6722 | 6737 | 111 |
| 337487 | 804 | 823 | CACTTGTATGTTCACCTCTG | 5-10-5 MOE | 30 | 7389 | 7408 | 28 |
| 233717 | 889 | 908 | TGAATTAATGTCCATGGACT | 5-10-5 MOE | 38 | 7876 | 7895 | 14 |

Example 6: Antisense Inhibition of Human ANGPTL3 in Hep3B Cells by MOE Gapmers

Additional antisense oligonucleotides were designed targeting an ANGPTL3 nucleic acid and were tested for their effects on ANGPTL3 mRNA in vitro. Cultured Hep3B cells at a density of 20,000 cells per well were transfected using electroporation with 4,500 nM antisense oligonucleotide. After a treatment period of approximately 24 hours, RNA was isolated from the cells and ANGPTL3mRNA levels were measured by quantitative real-time PCR. Human primer probe set RTS3492_MGB was used to measure mRNA levels. ANGPTL3 mRNA levels were adjusted according to total RNA content, as measured by RIBOGREEN®. Results are presented as percent inhibition of ANGPTL3, relative to untreated control cells.

The newly designed chimeric antisense oligonucleotides in the Tables below were designed as 5-10-5 MOE or 3-10-4 MOE gapmers. The 5-10-5 MOE gapmers are 20 nucleosides in length, wherein the central gap segment comprises often 2'-deoxynucleosides and is flanked by wing segments on the 5' direction and the 3' direction comprising five nucleosides each. The 3-10-4 MOE gapmers are 17 nucleosides in length, wherein the central gap segment comprises often 2'-deoxynucleosides and is flanked by wing segments on the 5' direction and the 3' direction comprising three and four nucleosides respectively. Each nucleoside in the 5' wing segment and each nucleoside in the 3' wing segment has a 2'-MOE modification. Each nucleoside in the 5' wing segment and each nucleoside in the 3' wing segment has a 2'-MOE modification. The internucleoside linkages throughout each gapmer are phosphorothioate (P=S) linkages. All cytosine residues throughout each gapmer are 5-methylcytosines. "Start site" indicates the 5'-most nucleoside to which the gapmer is targeted in the human gene sequence. "Stop site" indicates the 3'-most nucleoside to which the gapmer is targeted human gene sequence. Each gapmer listed in the Tables below is targeted to either the human ANGPTL3 mRNA, designated herein as SEQ ID NO: 1 (GENBANK Accession No. NM_014495.2) or the human ANGPTL3 genomic sequence, designated herein as SEQ ID NO: 2 (GENBANK Accession No. NT_032977.9 truncated from nucleotides 33032001 to 33046000). 'n/a' indicates that the antisense oligonucleotide does not target that particular gene sequence with 100% complementarity.

TABLE 31

Inhibition of ANGPTL3 mRNA by MOE gapmers targeting SEQ ID NO: 1 and 2

| ISIS NO | SEQ ID NO: 1 Start Site | SEQ ID NO: 1 Stop Site | Sequence | Motif | % inhibition | SEQ ID NO: 2 Start Site | SEQ ID NO: 2 Stop Site | SEQ ID NO |
|---|---|---|---|---|---|---|---|---|
| 582715 | N/A | N/A | CTGGGTATTACTCTTTTCTA | 5-10-5 | 60 | 5931 | 5950 | 4813 |
| 582716 | N/A | N/A | CTTGCTGGGTATTACTCTTT | 5-10-5 | 59 | 5935 | 5954 | 4814 |
| 582717 | N/A | N/A | TGCTTGCTGGGTATTACTCT | 5-10-5 | 59 | 5937 | 5956 | 4815 |
| 582718 | N/A | N/A | CATGAATGATATTTCCTAGG | 5-10-5 | 39 | 5987 | 6006 | 4816 |
| 582719 | N/A | N/A | GGCATGAATGATATTTCCTA | 5-10-5 | 60 | 5989 | 6008 | 4817 |
| 582720 | N/A | N/A | CTGGCATGAATGATATTTCC | 5-10-5 | 46 | 5991 | 6010 | 4818 |
| 582721 | N/A | N/A | TGCTGGCATGAATGATATTT | 5-10-5 | 32 | 5993 | 6012 | 4819 |
| 582722 | N/A | N/A | AAGTCCATATTTGTATTTCT | 5-10-5 | 50 | 6962 | 6981 | 4820 |
| 582723 | N/A | N/A | GCAAATGTAGCATTTTTTCA | 5-10-5 | 32 | 7246 | 7265 | 4821 |
| 582724 | N/A | N/A | GGCAAATGTAGCATTTTTTC | 5-10-5 | 55 | 7247 | 7266 | 4822 |
| 582725 | N/A | N/A | GTGGCAAATGTAGCATTTTT | 5-10-5 | 62 | 7249 | 7268 | 203 |
| 582726 | N/A | N/A | CTGGTCCTTTTAACTTCCAA | 5-10-5 | 40 | 8366 | 8385 | 4823 |
| 582727 | N/A | N/A | CCTGGTCCTTTTAACTTCCA | 5-10-5 | 58 | 8367 | 8386 | 4824 |
| 582728 | N/A | N/A | TTCCTGGTCCTTTTAACTTC | 5-10-5 | 32 | 8369 | 8388 | 4825 |
| 582729 | N/A | N/A | TGCTTAATGTATGCTTTCTT | 5-10-5 | 51 | 9079 | 9098 | 4826 |
| 582730 | N/A | N/A | CCGTAAGTTTATCTTCCTTT | 5-10-5 | 58 | 10136 | 10155 | 4827 |
| 582731 | N/A | N/A | CCCCGTAAGTTTATCTTCCT | 5-10-5 | 51 | 10138 | 10157 | 4828 |
| 582732 | N/A | N/A | CACAAATATGTTCATTCTTA | 5-10-5 | 22 | 11189 | 11208 | 4829 |
| 582733 | N/A | N/A | GCCACAAATATGTTCATTCT | 5-10-5 | 71 | 11191 | 11210 | 204 |
| 582734 | N/A | N/A | AAACTTTAACTCGATGCCAC | 5-10-5 | 51 | 11206 | 11225 | 4830 |
| 582735 | N/A | N/A | ATAAACTTTAACTCGATGCC | 5-10-5 | 57 | 11208 | 11227 | 4831 |
| 582736 | N/A | N/A | ATGCTTGTCAGGCTGTTTAA | 5-10-5 | 56 | 11311 | 11330 | 4832 |
| 582737 | N/A | N/A | GTCACCATATAACTTGGGCA | 5-10-5 | 48 | 11562 | 11581 | 4833 |
| 582738 | N/A | N/A | AGGTCACCATATAACTTGGG | 5-10-5 | 44 | 11564 | 11583 | 4834 |
| 582766 | N/A | N/A | GCTGGGTATTACTCTTT | 3-10-4 | 55 | 5935 | 5951 | 4835 |
| 582767 | N/A | N/A | GCATGAATGATATTTCC | 3-10-4 | 4 | 5991 | 6007 | 4836 |
| 582768 | N/A | N/A | GGCAAATGTAGCATTTT | 3-10-4 | 33 | 7250 | 7266 | 4837 |
| 582769 | N/A | N/A | CTGGTCCTTTTAACTTC | 3-10-4 | 29 | 8369 | 8385 | 4838 |
| 582770 | N/A | N/A | GTAAGTTTATCTTCCTT | 3-10-4 | 26 | 10137 | 10153 | 4839 |
| 582771 | N/A | N/A | ACTTTAACTCGATGCCA | 3-10-4 | 42 | 11207 | 11223 | 4840 |
| 582772 | N/A | N/A | AACTTTAACTCGATGCC | 3-10-4 | 55 | 11208 | 11224 | 4841 |
| 582773 | N/A | N/A | AAACTTTAACTCGATGC | 3-10-4 | 1 | 11209 | 11225 | 4842 |
| 582774 | N/A | N/A | GCTTGTCAGGCTGTTTA | 3-10-4 | 65 | 11312 | 11328 | 208 |
| 582775 | N/A | N/A | CACCATATAACTTGGGC | 3-10-4 | 38 | 11563 | 11579 | 4843 |
| 582776 | N/A | N/A | TCACCATATAACTTGGG | 3-10-4 | 37 | 11564 | 11580 | 4844 |
| 582777 | N/A | N/A | GTCACCATATAACTTGG | 3-10-4 | 31 | 11565 | 11581 | 4845 |

TABLE 31-continued

Inhibition of ANGPTL3 mRNA by MOE gapmers targeting SEQ ID NO: 1 and 2

| ISIS NO | SEQ ID NO: 1 Start Site | SEQ ID NO: 1 Stop Site | Sequence | Motif | % inhibition | SEQ ID NO: 2 Start Site | SEQ ID NO: 2 Stop Site | SEQ ID NO |
|---|---|---|---|---|---|---|---|---|
| 582702 | 139 | 158 | CTTGATTTTGGCTCTGGAGA | 5-10-5 | 53 | 3243 | 3262 | 4846 |
| 582739 | 140 | 156 | TGATTTTGGCTCTGGAG | 3-10-4 | 41 | 3244 | 3260 | 4847 |
| 582703 | 141 | 160 | ATCTTGATTTTGGCTCTGGA | 5-10-5 | 64 | 3245 | 3264 | 198 |
| 582740 | 305 | 321 | ACTGGTTTGCAGCGATA | 3-10-4 | 58 | 3409 | 3425 | 4848 |
| 582704 | 306 | 325 | TTTCACTGGTTTGCAGCGAT | 5-10-5 | 60 | 3410 | 3429 | 4849 |
| 582741 | 306 | 322 | CACTGGTTTGCAGCGAT | 3-10-4 | 57 | 3410 | 3426 | 4850 |
| 582742 | 307 | 323 | TCACTGGTTTGCAGCGA | 3-10-4 | 60 | 3411 | 3427 | 4851 |
| 582705 | 706 | 725 | GTTCTTGGTGCTCTTGGCTT | 5-10-5 | 78 | 6719 | 6738 | 199 |
| 544120 | 707 | 726 | AGTTCTTGGTGCTCTTGGCT | 5-10-5 | 75 | 6720 | 6739 | 15 |
| 582743 | 707 | 723 | TCTTGGTGCTCTTGGCT | 3-10-4 | 63 | 6720 | 6736 | 205 |
| 582706 | 708 | 727 | TAGTTCTTGGTGCTCTTGGC | 5-10-5 | 69 | 6721 | 6740 | 200 |
| 582744 | 708 | 724 | TTCTTGGTGCTCTTGGC | 3-10-4 | 51 | 6721 | 6737 | 4852 |
| 582745 | 709 | 725 | GTTCTTGGTGCTCTTGG | 3-10-4 | 50 | 6722 | 6738 | 4853 |
| 337487 | 804 | 823 | CACTTGTATGTTCACCTCTG | 5-10-5 | 25 | 7389 | 7408 | 28 |
| 233717 | 889 | 908 | TGAATTAATGTCCATGGACT | 5-10-5 | 22 | 7876 | 7895 | 14 |
| 582707 | 1054 | 1073 | TTGTCTTTCCAGTCTTCCAA | 5-10-5 | 42 | 9629 | 9648 | 4854 |
| 582708 | 1056 | 1075 | TGTTGTCTTTCCAGTCTTCC | 5-10-5 | 52 | 9631 | 9650 | 4855 |
| 582746 | 1140 | 1156 | CATTGCCAGTAATCGCA | 3-10-4 | 53 | 9715 | 9731 | 4856 |
| 582747 | 1141 | 1157 | ACATTGCCAGTAATCGC | 3-10-4 | 61 | 9716 | 9732 | 4857 |
| 582748 | 1142 | 1158 | GACATTGCCAGTAATCG | 3-10-4 | 34 | 9717 | 9733 | 4858 |
| 582709 | 1194 | 1213 | CTTTGTGATCCCAAGTAGAA | 5-10-5 | 28 | 9769 | 9788 | 4859 |
| 582749 | 1195 | 1211 | TTGTGATCCCAAGTAGA | 3-10-4 | 16 | 9770 | 9786 | 4860 |
| 582710 | 1196 | 1215 | TGCTTTGTGATCCCAAGTAG | 5-10-5 | 54 | 9771 | 9790 | 4861 |
| 582750 | 1196 | 1212 | TTTGTGATCCCAAGTAG | 3-10-4 | 19 | 9771 | 9787 | 4862 |
| 582751 | 1197 | 1213 | CTTTGTGATCCCAAGTA | 3-10-4 | 32 | 9772 | 9788 | 4863 |
| 582752 | 1260 | 1276 | CACACTCATCATGCCAC | 3-10-4 | 42 | 10232 | 10248 | 4864 |
| 582711 | 1268 | 1287 | GTTGTTTTCTCCACACTCAT | 5-10-5 | 51 | 10240 | 10259 | 4865 |
| 582712 | 1270 | 1289 | AGGTTGTTTTCTCCACACTC | 5-10-5 | 63 | 10242 | 10261 | 201 |
| 582753 | 1307 | 1323 | AGATTTTGCTCTTGGTT | 3-10-4 | 54 | 10279 | 10295 | 4866 |
| 582754 | 1308 | 1324 | TAGATTTTGCTCTTGGT | 3-10-4 | 52 | 10280 | 10296 | 4867 |
| 582755 | 1309 | 1325 | TTAGATTTTGCTCTTGG | 3-10-4 | 44 | 10281 | 10297 | 4868 |
| 582756 | 1310 | 1326 | CTTAGATTTTGCTCTTG | 3-10-4 | 34 | 10282 | 10298 | 4869 |
| 567320 | 1487 | 1506 | CCAGATTATTAGACCACATT | 5-10-5 | 77 | 10459 | 10478 | 93 |
| 582757 | 1488 | 1504 | AGATTATTAGACCACAT | 3-10-4 | 0 | 10460 | 10476 | 4870 |
| 582758 | 1489 | 1505 | CAGATTATTAGACCACA | 3-10-4 | 39 | 10461 | 10477 | 4871 |
| 582759 | 1490 | 1506 | CCAGATTATTAGACCAC | 3-10-4 | 63 | 10462 | 10478 | 206 |

TABLE 31-continued

Inhibition of ANGPTL3 mRNA by MOE gapmers targeting SEQ ID NO: 1 and 2

| ISIS NO | SEQ ID NO: 1 Start Site | SEQ ID NO: 1 Stop Site | Sequence | Motif | % inhibition | SEQ ID NO: 2 Start Site | SEQ ID NO: 2 Stop Site | SEQ ID NO |
|---|---|---|---|---|---|---|---|---|
| 582760 | 1491 | 1507 | ACCAGATTATTAGACCA | 3-10-4 | 31 | 10463 | 10479 | 4872 |
| 582761 | 1763 | 1779 | GCTCATATGATGCCTTT | 3-10-4 | 71 | 10735 | 10751 | 207 |
| 582713 | 1906 | 1925 | ACACATACTCTGTGCTGACG | 5-10-5 | 68 | 10878 | 10897 | 202 |
| 582762 | 1907 | 1923 | ACATACTCTGTGCTGAC | 3-10-4 | 57 | 10879 | 10895 | 4873 |
| 582714 | 1908 | 1927 | TTACACATACTCTGTGCTGA | 5-10-5 | 49 | 10880 | 10899 | 4874 |
| 582763 | 2071 | 2087 | CTTAGTAGTCATCTCCA | 3-10-4 | 49 | 11043 | 11059 | 4875 |
| 582764 | 2072 | 2088 | ACTTAGTAGTCATCTCC | 3-10-4 | 53 | 11044 | 11060 | 4876 |
| 582765 | 2073 | 2089 | GACTTAGTAGTCATCTC | 3-10-4 | 36 | 11045 | 11061 | 4877 |

Example 7: Dose-Dependent Antisense Inhibition of Human ANGPTL3 in Hep3B Cells Deoxy, MOE, and cEt oligonucleotides from the studies described above exhibiting significant in vitro inhibition of ANGPTL3 mRNA were selected and tested at various doses in Hep3B cells. ISIS 233717 and ISIS 337847, both 5-10-5 MOE gapmers, were also included in the studies. The antisense oligonucleotides were tested in a series of experiments that had similar culture conditions. The results of each experiment are presented in separate tables below.

Cells were plated at a density of 20,000 cells per well and transfected using electroporation with 0.813 µM, 1.625 µM, 3.25 µM, 6.500 µM and 13.00 µM concentrations of antisense oligonucleotide, as specified in the Table below. After a treatment period of approximately 16 hours, RNA was isolated from the cells and ANGPTL3 mRNA levels were measured by quantitative real-time PCR. Human primer probe set RTS3492_MGB was used to measure mRNA levels. ANGPTL3 mRNA levels were adjusted according to total RNA content, as measured by RIBOGREEN®. Results are presented as percent inhibition of ANGPTL3, relative to untreated control cells.

The half maximal inhibitory concentration (IC$_{50}$) of each oligonucleotide is also presented. ANGPTL3 mRNA levels were significantly reduced in a dose-dependent manner in antisense oligonucleotide treated cells.

TABLE 32

| ISIS No | 0.813 µM | 1.625 µM | 3.25 µM | 6.50 µM | 13.00 µM | IC$_{50}$ (µM) | SEQ ID NO |
|---|---|---|---|---|---|---|---|
| 233717 | 0 | 27 | 43 | 66 | 79 | 4.4 | 14 |
| 337487 | 26 | 49 | 63 | 85 | 94 | 2.0 | 28 |
| 559277 | 54 | 68 | 70 | 82 | 91 | <0.8 | 110 |
| 560990 | 36 | 61 | 74 | 90 | 96 | 1.2 | 111 |
| 560992 | 60 | 67 | 76 | 81 | 93 | <0.8 | 112 |
| 561010 | 71 | 77 | 82 | 86 | 94 | <0.8 | 113 |
| 561011 | 80 | 87 | 91 | 95 | 97 | <0.8 | 114 |
| 561022 | 75 | 79 | 84 | 89 | 93 | <0.8 | 115 |
| 561025 | 68 | 82 | 81 | 91 | 96 | <0.8 | 116 |
| 561026 | 72 | 85 | 85 | 89 | 90 | <0.8 | 117 |
| 561208 | 63 | 80 | 87 | 92 | 93 | <0.8 | 118 |
| 561320 | 47 | 60 | 86 | 92 | 96 | 0.8 | 119 |
| 561343 | 45 | 59 | 79 | 86 | 93 | 0.9 | 120 |

TABLE 32-continued

| ISIS No | 0.813 µM | 1.625 µM | 3.25 µM | 6.50 µM | 13.00 µM | IC$_{50}$ (µM) | SEQ ID NO |
|---|---|---|---|---|---|---|---|
| 561345 | 38 | 59 | 80 | 88 | 95 | 1.1 | 121 |
| 561347 | 53 | 63 | 84 | 88 | 97 | <0.8 | 122 |

TABLE 33

| ISIS No | 0.813 µM | 1.625 µM | 3.25 µM | 6.50 µM | 13.00 µM | IC$_{50}$ (µM) | SEQ ID NO |
|---|---|---|---|---|---|---|---|
| 233717 | 7 | 19 | 55 | 60 | 77 | 4.2 | 14 |
| 337487 | 33 | 44 | 69 | 83 | 88 | 2.0 | 28 |
| 560990 | 36 | 64 | 81 | 87 | 95 | 1.1 | 111 |
| 561452 | 58 | 69 | 75 | 85 | 88 | <0.8 | 123 |
| 561458 | 69 | 77 | 84 | 91 | 94 | <0.8 | 124 |
| 561460 | 54 | 50 | 72 | 79 | 85 | <0.8 | 125 |
| 561462 | 49 | 72 | 80 | 90 | 92 | <0.8 | 126 |
| 561463 | 63 | 79 | 84 | 92 | 93 | <0.8 | 127 |
| 561478 | 56 | 53 | 80 | 86 | 91 | <0.8 | 128 |
| 561482 | 46 | 69 | 80 | 86 | 91 | <0.8 | 129 |
| 561486 | 56 | 73 | 80 | 91 | 92 | <0.8 | 130 |
| 561487 | 82 | 87 | 88 | 90 | 93 | <0.8 | 131 |
| 561500 | 52 | 60 | 71 | 80 | 91 | <0.8 | 132 |
| 561504 | 49 | 72 | 85 | 91 | 93 | <0.8 | 133 |
| 561621 | 68 | 76 | 85 | 91 | 94 | <0.8 | 134 |

TABLE 34

| ISIS No | 0.813 µM | 1.625 µM | 3.25 µM | 6.50 µM | 13.00 µM | IC$_{50}$ (µM) | SEQ ID NO |
|---|---|---|---|---|---|---|---|
| 233717 | 28 | 35 | 48 | 56 | 60 | 4.7 | 14 |
| 337487 | 43 | 58 | 72 | 82 | 89 | 1.0 | 28 |
| 560990 | 57 | 73 | 82 | 86 | 96 | <0.8 | 111 |
| 561620 | 51 | 74 | 80 | 85 | 88 | <0.8 | 135 |
| 561622 | 63 | 73 | 85 | 88 | 87 | <0.8 | 136 |
| 561628 | 48 | 69 | 77 | 79 | 80 | <0.8 | 137 |
| 561631 | 60 | 75 | 84 | 86 | 90 | <0.8 | 138 |
| 561644 | 59 | 69 | 77 | 85 | 83 | <0.8 | 139 |
| 561646 | 67 | 81 | 84 | 91 | 92 | <0.8 | 140 |
| 561649 | 70 | 76 | 85 | 89 | 89 | <0.8 | 141 |
| 561650 | 78 | 85 | 88 | 90 | 91 | <0.8 | 142 |
| 561770 | 66 | 81 | 79 | 88 | 91 | <0.8 | 143 |
| 561781 | 65 | 67 | 80 | 81 | 91 | <0.8 | 144 |
| 561791 | 68 | 73 | 83 | 82 | 85 | <0.8 | 145 |
| 561918 | 63 | 71 | 81 | 86 | 92 | <0.8 | 146 |

TABLE 35

| ISIS No | 0.813 µM | 1.625 µM | 3.25 µM | 6.50 µM | 13.00 µM | IC$_{50}$ (µM) | SEQ ID NO |
|---|---|---|---|---|---|---|---|
| 233717 | 21 | 26 | 47 | 62 | 69 | 4.2 | 14 |
| 337487 | 35 | 54 | 73 | 82 | 92 | 1.0 | 28 |
| 560990 | 42 | 76 | 81 | 88 | 96 | <0.8 | 111 |
| 562078 | 55 | 85 | 86 | 91 | 93 | <0.8 | 147 |
| 562086 | 64 | 83 | 87 | 92 | 93 | <0.8 | 148 |
| 562103 | 72 | 83 | 90 | 90 | 94 | <0.8 | 149 |
| 562110 | 66 | 80 | 83 | 89 | 92 | <0.8 | 150 |
| 562375 | 56 | 61 | 63 | 84 | 90 | <0.8 | 151 |
| 562387 | 67 | 75 | 81 | 90 | 88 | <0.8 | 152 |
| 562396 | 60 | 71 | 80 | 80 | 85 | <0.8 | 153 |
| 562415 | 66 | 73 | 77 | 77 | 81 | <0.8 | 154 |
| 562433 | 68 | 84 | 86 | 90 | 91 | <0.8 | 155 |
| 562436 | 78 | 87 | 87 | 91 | 94 | <0.8 | 156 |
| 562439 | 55 | 66 | 78 | 82 | 93 | <0.8 | 157 |
| 562442 | 55 | 57 | 60 | 76 | 86 | <0.8 | 158 |

Example 8: Dose-Dependent Antisense Inhibition of Human ANGPTL3 in Hep3B Cells Deoxy, MOE, and cEt oligonucleotides from the studies described above exhibiting significant in vitro inhibition of ANGPTL3 mRNA were selected and tested at various doses in Hep3B cells. ISIS 337847, a 5-10-5 MOE gapmer, was also included in the studies. The antisense oligonucleotides were tested in a series of experiments that had similar culture conditions. The results of each experiment are presented in separate tables below.

Cells were plated at a density of 20,000 cells per well and transfected using electroporation with 0.160 µM, 0.481 µM, 1.444 µM, 4.333 µM and 13.00 µM concentrations of antisense oligonucleotide, as specified in the Table below. After a treatment period of approximately 16 hours, RNA was isolated from the cells and ANGPTL3 mRNA levels were measured by quantitative real-time PCR. Human primer probe set RTS3492_MGB was used to measure mRNA levels. ANGPTL3 mRNA levels were adjusted according to total RNA content, as measured by RIBOGREEN. Results are presented as percent inhibition of ANGPTL3, relative to untreated control cells.

The half maximal inhibitory concentration (IC$_{50}$) of each oligonucleotide is also presented. ANGPTL3 mRNA levels were significantly reduced in a dose-dependent manner in antisense oligonucleotide treated cells.

TABLE 36

| ISIS No | 0.160 µM | 0.481 µM | 1.444 µM | 4.333 µM | 13.00 µM | IC$_{50}$ (µM) | SEQ ID NO |
|---|---|---|---|---|---|---|---|
| 337487 | 0 | 18 | 24 | 49 | 73 | 4.1 | 28 |
| 560990 | 2 | 27 | 39 | 59 | 80 | 2.0 | 111 |
| 561076 | 20 | 33 | 59 | 73 | 89 | 1.1 | 159 |
| 561079 | 24 | 39 | 51 | 72 | 84 | 1.0 | 160 |
| 561084 | 7 | 17 | 46 | 66 | 87 | 1.9 | 161 |
| 561085 | 21 | 35 | 55 | 69 | 86 | 1.2 | 162 |
| 561123 | 20 | 39 | 52 | 72 | 87 | 1.1 | 163 |
| 561241 | 13 | 22 | 41 | 68 | 86 | 2.0 | 164 |
| 561256 | 12 | 22 | 35 | 54 | 82 | 2.6 | 165 |
| 561260 | 22 | 16 | 34 | 54 | 82 | 2.6 | 166 |
| 561277 | 21 | 21 | 37 | 59 | 69 | 2.9 | 167 |
| 561288 | 6 | 8 | 23 | 36 | 68 | 6.9 | 168 |
| 561418 | 25 | 36 | 61 | 79 | 86 | 0.9 | 169 |
| 561436 | 21 | 40 | 61 | 77 | 88 | 0.9 | 170 |
| 561443 | 18 | 32 | 52 | 82 | 88 | 1.1 | 171 |

TABLE 37

| ISIS No | 0.160 µM | 0.481 µM | 1.444 µM | 4.333 µM | 13.00 µM | IC$_{50}$ (µM) | SEQ ID NO |
|---|---|---|---|---|---|---|---|
| 337487 | 0 | 8 | 21 | 52 | 81 | 3.7 | 28 |
| 560990 | 6 | 14 | 40 | 61 | 74 | 3.0 | 111 |
| 561398 | 3 | 9 | 22 | 64 | 79 | 3.0 | 172 |
| 561400 | 11 | 28 | 50 | 65 | 83 | 1.7 | 173 |
| 561528 | 2 | 39 | 59 | 74 | 84 | 1.3 | 174 |
| 561565 | 18 | 43 | 58 | 75 | 83 | 1.0 | 175 |
| 561566 | 21 | 29 | 54 | 71 | 79 | 1.4 | 176 |
| 561567 | 16 | 35 | 56 | 67 | 78 | 1.4 | 177 |
| 561571 | 18 | 32 | 60 | 80 | 86 | 1.1 | 178 |
| 561576 | 11 | 12 | 42 | 65 | 77 | 2.4 | 179 |
| 561689 | 16 | 27 | 52 | 76 | 80 | 1.4 | 180 |
| 561698 | 1 | 24 | 31 | 61 | 74 | 2.9 | 181 |
| 561699 | 2 | 19 | 48 | 65 | 81 | 2.0 | 182 |
| 561722 | 14 | 34 | 59 | 72 | 85 | 1.2 | 183 |
| 561723 | 7 | 31 | 69 | 71 | 75 | 1.4 | 184 |

TABLE 38

| ISIS No | 0.160 µM | 0.481 µM | 1.444 µM | 4.333 µM | 13.00 µM | IC$_{50}$ (µM) | SEQ ID NO |
|---|---|---|---|---|---|---|---|
| 337487 | 14 | 9 | 9 | 47 | 72 | 5.9 | 28 |
| 560990 | 13 | 26 | 39 | 58 | 81 | 2.0 | 111 |
| 561888 | 16 | 19 | 46 | 72 | 84 | 1.7 | 185 |
| 561897 | 6 | 31 | 50 | 67 | 82 | 2.0 | 186 |
| 561996 | 19 | 31 | 49 | 59 | 83 | 1.6 | 187 |
| 562001 | 22 | 46 | 57 | 67 | 89 | 0.9 | 188 |
| 562024 | 17 | 29 | 59 | 71 | 83 | 1.3 | 189 |
| 562050 | 21 | 38 | 46 | 62 | 74 | 1.6 | 190 |
| 562153 | 22 | 35 | 42 | 61 | 71 | 2.0 | 191 |
| 562155 | 29 | 29 | 50 | 72 | 84 | 1.2 | 192 |
| 562156 | 15 | 17 | 39 | 60 | 82 | 2.3 | 193 |
| 562157 | 14 | 15 | 43 | 54 | 75 | 3.0 | 194 |
| 562181 | 24 | 34 | 58 | 73 | 80 | 1.1 | 195 |
| 562314 | 22 | 30 | 42 | 54 | 64 | 3.1 | 196 |
| 562365 | 25 | 27 | 46 | 64 | 77 | 1.7 | 197 |

Example 9: Dose-Dependent Antisense Inhibition of Human ANGPTL3 in Hep3B Cells by MOE Gapmers MOE gapmers from the Examples above exhibiting significant in vitro inhibition of ANGPTL3 mRNA were selected and tested at various doses in Hep3B cells. Cells were plated at a density of 20,000 cells per well and transfected using electroporation with 0.160 µM, 0.481 µM, 1.444 µM, 4.333 µM and 13.00 µM concentrations of antisense oligonucleotide, as specified in the Table below. After a treatment period of approximately 16 hours, RNA was isolated from the cells and ANGPTL3 mRNA levels were measured by quantitative real-time PCR. Human primer probe set RTS3492_MGB was used to measure mRNA levels. ANGPTL3 mRNA levels were adjusted according to total RNA content, as measured by RIBOGREEN®. Results are presented as percent inhibition of ANGPTL3, relative to untreated control cells.

The half maximal inhibitory concentration (IC$_{50}$) of each oligonucleotide is also presented. ANGPTL3 mRNA levels were significantly reduced in a dose-dependent manner in antisense oligonucleotide treated cells.

TABLE 39

| ISIS No | Motif | 0.16 (μM) | 0.48 (μM) | 1.44 (μM) | 4.33 (μM) | 13.00 (μM) | IC$_{50}$ (μM) | SEQ ID NO |
|---|---|---|---|---|---|---|---|---|
| 233717 | 5-10-5 | 0 | 3 | 12 | 38 | 64 | 8.0 | 14 |
| 337487 | 5-10-5 | 0 | 0 | 15 | 30 | 66 | 8.0 | 28 |
| 544120 | 5-10-5 | 10 | 37 | 62 | 81 | 94 | 1.0 | 15 |
| 567320 | 5-10-5 | 0 | 30 | 67 | 84 | 95 | 1.1 | 93 |
| 582703 | 5-10-5 | 0 | 18 | 47 | 71 | 83 | 2.0 | 198 |
| 582705 | 5-10-5 | 22 | 18 | 46 | 82 | 93 | 1.0 | 199 |
| 582706 | 5-10-5 | 2 | 0 | 32 | 67 | 85 | 2.6 | 200 |
| 582712 | 5-10-5 | 0 | 0 | 54 | 71 | 89 | 2.2 | 201 |
| 582713 | 5-10-5 | 25 | 25 | 52 | 75 | 85 | 1.2 | 202 |
| 582725 | 5-10-5 | 0 | 3 | 43 | 62 | 84 | 2.7 | 203 |
| 582733 | 5-10-5 | 0 | 30 | 66 | 77 | 87 | 1.3 | 204 |
| 582743 | 3-10-4 | 0 | 6 | 37 | 51 | 87 | 2.9 | 205 |
| 582759 | 3-10-4 | 0 | 2 | 51 | 76 | 93 | 2.0 | 206 |
| 582761 | 3-10-4 | 4 | 38 | 58 | 72 | 87 | 1.3 | 207 |
| 582774 | 3-10-4 | 5 | 29 | 46 | 72 | 86 | 1.6 | 208 |

Example 10: Dose-Dependent Antisense Inhibition of Human ANGPTL3 in Hep3B Cells by Deoxy, MOE and cEt Oligonucleotides Deoxy, MOE, and cEt oligonucleotides from the studies described above exhibiting significant in vitro inhibition of ANGPTL3 mRNA were selected and tested at various doses in Hep3B cells. Cells were plated at a density of 20,000 cells per well and transfected using electroporation with 0.111 μM, 0.333 μM, 1.00 μM, 3.00 μM and 9.00 μM concentrations of antisense oligonucleotide, as specified in the Table below. After a treatment period of approximately 16 hours, RNA was isolated from the cells and ANGPTL3 mRNA levels were measured by quantitative real-time PCR. Human primer probe set RTS3492_MGB was used to measure mRNA levels. ANGPTL3 mRNA levels were adjusted according to total RNA content, as measured by RIBOGREEN®. Results are presented as percent inhibition of ANGPTL3, relative to untreated control cells.

The half maximal inhibitory concentration (IC$_{50}$) of each oligonucleotide is also presented. ANGPTL3 mRNA levels were significantly reduced in a dose-dependent manner in antisense oligonucleotide treated cells.

TABLE 40

| ISIS No | 0.111 (μM) | 0.333 (μM) | 1.00 (μM) | 3.00 (μM) | 9.00 (μM) | IC$_{50}$ (μM) | SEQ ID NO |
|---|---|---|---|---|---|---|---|
| 561011 | 20 | 39 | 65 | 81 | 94 | 0.5 | 114 |
| 561026 | 23 | 43 | 65 | 84 | 94 | 0.5 | 117 |
| 561463 | 26 | 25 | 59 | 76 | 91 | 0.7 | 127 |
| 561487 | 42 | 61 | 81 | 89 | 95 | 0.1 | 131 |
| 586661 | 24 | 36 | 46 | 76 | 92 | 0.7 | 209 |
| 586669 | 31 | 50 | 68 | 85 | 95 | 0.3 | 210 |
| 586676 | 26 | 50 | 73 | 83 | 95 | 0.3 | 211 |
| 586688 | 4 | 24 | 51 | 82 | 91 | 0.9 | 212 |
| 586690 | 19 | 39 | 64 | 84 | 95 | 0.5 | 213 |
| 586691 | 6 | 37 | 60 | 81 | 93 | 0.7 | 214 |
| 586701 | 10 | 32 | 55 | 76 | 90 | 0.8 | 215 |
| 586702 | 16 | 25 | 55 | 69 | 86 | 0.9 | 216 |
| 586705 | 10 | 30 | 54 | 80 | 89 | 0.8 | 217 |
| 586707 | 33 | 42 | 71 | 83 | 89 | 0.3 | 218 |
| 586718 | 38 | 54 | 72 | 78 | 85 | 0.2 | 219 |

TABLE 41

| ISIS No | 0.111 (μM) | 0.333 (μM) | 1.00 (μM) | 3.00 (μM) | 9.00 (μM) | IC$_{50}$ (μM) | SEQ ID NO |
|---|---|---|---|---|---|---|---|
| 561011 | 13 | 29 | 41 | 76 | 89 | 1.0 | 114 |
| 561567 | 20 | 46 | 57 | 75 | 78 | 0.7 | 177 |
| 586692 | 32 | 30 | 71 | 85 | 95 | 0.4 | 220 |
| 586700 | 3 | 46 | 70 | 82 | 95 | 1.0 | 221 |
| 586708 | 36 | 46 | 62 | 77 | 86 | 0.4 | 222 |
| 586744 | 0 | 19 | 54 | 81 | 92 | 1.0 | 223 |
| 586745 | 35 | 22 | 66 | 78 | 92 | 0.5 | 224 |
| 586746 | 14 | 30 | 59 | 82 | 92 | 0.7 | 225 |
| 586755 | 18 | 22 | 53 | 74 | 90 | 0.9 | 226 |
| 586761 | 26 | 26 | 54 | 73 | 90 | 0.8 | 227 |
| 586787 | 0 | 38 | 64 | 79 | 90 | 0.8 | 228 |
| 586796 | 12 | 13 | 56 | 83 | 93 | 0.9 | 229 |
| 586797 | 4 | 26 | 58 | 82 | 90 | 0.9 | 230 |
| 586802 | 12 | 28 | 56 | 76 | 81 | 0.9 | 231 |
| 586804 | 17 | 40 | 65 | 86 | 93 | 0.5 | 232 |

TABLE 42

| ISIS No | 0.111 (μM) | 0.333 (μM) | 1.00 (μM) | 3.00 (μM) | 9.00 (μM) | IC$_{50}$ (μM) | SEQ ID NO |
|---|---|---|---|---|---|---|---|
| 561011 | 20 | 48 | 75 | 84 | 94 | 0.4 | 114 |
| 561026 | 31 | 48 | 70 | 88 | 95 | 0.3 | 117 |
| 561463 | 27 | 40 | 67 | 85 | 94 | 0.4 | 127 |
| 561487 | 41 | 66 | 84 | 91 | 95 | 0.1 | 131 |
| 586661 | 36 | 45 | 64 | 82 | 91 | 0.3 | 209 |
| 586669 | 21 | 55 | 73 | 90 | 96 | 0.3 | 210 |
| 586676 | 23 | 59 | 77 | 87 | 94 | 0.3 | 211 |
| 586688 | 25 | 41 | 70 | 82 | 93 | 0.4 | 212 |
| 586690 | 16 | 45 | 74 | 86 | 92 | 0.5 | 213 |
| 586691 | 13 | 40 | 65 | 86 | 92 | 0.6 | 214 |
| 586701 | 22 | 49 | 70 | 82 | 93 | 0.4 | 215 |
| 586702 | 11 | 31 | 58 | 76 | 92 | 0.8 | 216 |
| 586705 | 26 | 45 | 66 | 82 | 89 | 0.4 | 217 |
| 586707 | 28 | 58 | 75 | 85 | 88 | 0.3 | 218 |
| 586718 | 33 | 59 | 73 | 80 | 88 | 0.2 | 219 |

TABLE 43

| ISIS No | 0.111 (μM) | 0.333 (μM) | 1.00 (μM) | 3.00 (μM) | 9.00 (μM) | IC$_{50}$ (μM) | SEQ ID NO |
|---|---|---|---|---|---|---|---|
| 561011 | 23 | 41 | 63 | 82 | 92 | 0.5 | 114 |
| 561567 | 31 | 44 | 65 | 75 | 83 | 0.4 | 177 |
| 586692 | 16 | 58 | 74 | 89 | 93 | 0.4 | 220 |
| 586700 | 25 | 62 | 75 | 91 | 94 | 0.3 | 221 |
| 586708 | 36 | 53 | 72 | 81 | 90 | 0.3 | 222 |
| 586744 | 30 | 29 | 64 | 75 | 94 | 0.6 | 223 |
| 586745 | 21 | 44 | 59 | 81 | 89 | 0.5 | 224 |
| 586746 | 19 | 48 | 57 | 85 | 87 | 0.5 | 225 |
| 586755 | 6 | 30 | 59 | 78 | 89 | 0.8 | 226 |
| 586761 | 12 | 29 | 59 | 72 | 87 | 0.9 | 227 |
| 586787 | 27 | 35 | 64 | 84 | 97 | 0.5 | 228 |
| 586796 | 31 | 40 | 72 | 91 | 95 | 0.3 | 229 |
| 586797 | 36 | 47 | 67 | 82 | 88 | 0.3 | 230 |
| 586802 | 35 | 32 | 61 | 76 | 90 | 0.5 | 231 |
| 586804 | 35 | 50 | 75 | 91 | 91 | 0.2 | 232 |

Example 11: Antisense Inhibition of Human ANGPTL3 in huANGPTL3 Transgenic Mice Antisense oligonucleotides described in the studies above were further evaluated for their ability to reduce human ANGPTL3 mRNA transcript in C57Bl/6 mice with the human ANGPTL3 transgene (Tg mice).

Study 1

Female Tg mice were maintained on a 12-hour light/dark cycle. Animals were acclimated for at least 7 days in the research facility before initiation of the experiment. Antisense oligonucleotides (ASOs) were prepared in buffered saline (PBS) and sterilized by filtering through a 0.2 micron filter. Oligonucleotides were dissolved in 0.9% PBS for injection.

Groups of mice received intraperitoneal injections of 5-10-5 MOE gapmers at a dose of 50 mg/kg once per week for 2 weeks. One group of mice received subcutaneous injections of PBS once weekly for 2 weeks. The PBS-injected group served as the control group to which the corresponding oligonucleotide-treated groups were compared.

RNA Analysis

At the end of the treatment period, RNA was extracted from liver for real-time PCR analysis of measurement of mRNA expression of ANGPTL3 with RTS3492_MGB. mRNA levels were also measured with human primer probe set RTS1984 (forward sequence CTTCAATGAAACGTGGGAGAACT, designated herein as SEQ ID NO: 7; reverse sequence TCTCTAGGCCCAACCAAAATTC, designated herein as SEQ ID NO: 8; probe sequence AAATATGGTTTTGGGAGGCTTGAT, designated herein as SEQ ID NO: 9). Results are presented as percent change of mRNA, relative to PBS control, normalized with RIBOGREEN®. As shown in the Table below, treatment with ISIS antisense oligonucleotides resulted in significant reduction of ANGPTL3 mRNA in comparison to the PBS control.

TABLE 44

Percent inhibition of ANGPTL3 mRNA in transgenic mouse liver relative to the PBS control

| ISIS No | RTS3492_MGB | RTS1984 | SEQ ID NO |
|---|---|---|---|
| 233710 | 91 | 94 | 233 |
| 233717 | 49 | 58 | 14 |
| 337477 | 76 | 82 | 234 |
| 337478 | 52 | 65 | 235 |
| 337479 | 53 | 76 | 236 |
| 337487 | 80 | 92 | 28 |

Protein Analysis

Human ANGPTL3 protein levels were quantified using a commercially available ELISA kit (Catalog #DANL30 by R&D Systems, Minneapolis, Minn.) with transgenic plasma samples diluted 1:20,000 using the manufacturer described protocol. The results are presented in the Table below. The results indicate that treatment with ISIS oligonucleotides resulted in reduced ANGPTL3 protein levels.

TABLE 45

Percent inhibition of plasma protein levels in the transgenic mouse

| ISIS No | % | SEQ ID NO |
|---|---|---|
| 233710 | 92 | 233 |
| 233717 | 47 | 14 |
| 337477 | 68 | 234 |
| 337478 | 36 | 235 |
| 337479 | 48 | 236 |
| 337487 | 78 | 28 |

Plasma Chemistry Markers

To evaluate the effect of ISIS oligonucleotides on day 10, plasma levels of transaminases (ALT and AST) were measured using an automated clinical chemistry analyzer (Hitachi Olympus AU400e, Melville, N.Y.). The results are presented in the Table below. ISIS oligonucleotides that caused changes in the levels of any of these liver function markers outside the expected range for antisense oligonucleotides were excluded in further studies.

TABLE 46

Plasma transaminase levels (IU/L) in transgenic mice on day 10

|  | ALT | AST | SEQ ID NO |
|---|---|---|---|
| PBS | 27 | 36 |  |
| ISIS 233710 | 19 | 37 | 233 |
| ISIS 233717 | 16 | 32 | 14 |
| ISIS 337477 | 22 | 35 | 234 |
| ISIS 337478 | 23 | 49 | 235 |
| ISIS 337479 | 21 | 29 | 236 |
| ISIS 337487 | 19 | 35 | 28 |

Study 2

Male Tg mice were maintained on a 12-hour light/dark cycle. Animals were acclimated for at least 7 days in the research facility before initiation of the experiment. Antisense oligonucleotides (ASOs) were prepared in buffered saline (PBS) and sterilized by filtering through a 0.2 micron filter. Oligonucleotides were dissolved in 0.9% PBS for injection.

Groups of mice received intraperitoneal injections of 5-10-5 MOE gapmers at a dose of 50 mg/kg once per week for 2 weeks. One group of mice received subcutaneous injections of PBS once weekly for 2 weeks. The PBS-injected groups served as the control groups to which the corresponding oligonucleotide-treated groups were compared.

RNA Analysis

At the end of the treatment period, RNA was extracted from liver for real-time PCR analysis of measurement of mRNA expression of ANGPTL3 with RTS1984. Results are presented as percent change of mRNA, relative to PBS control, normalized with RIBOGREEN. As shown in the Table below, treatment with ISIS antisense oligonucleotides resulted in significant reduction of ANGPTL3 mRNA in comparison to the PBS control.

TABLE 47

Percent inhibition of ANGPTL3 mRNA in transgenic mouse liver relative to the PBS control

| ISIS No | % | SEQ ID NO |
|---|---|---|
| 233710 | 81 | 233 |
| 337487 | 92 | 28 |
| 544145 | 98 | 16 |
| 544162 | 75 | 18 |
| 544199 | 97 | 20 |
| 560306 | 90 | 34 |
| 560400 | 97 | 35 |
| 560401 | 95 | 36 |
| 560402 | 98 | 37 |
| 560469 | 98 | 38 |
| 560735 | 87 | 49 |
| 567320 | 95 | 93 |
| 567321 | 93 | 94 |

Protein Analysis

Human ANGPTL3 protein levels were quantified using a commercially available ELISA kit (Catalog #DANL30 by R&D Systems, Minneapolis, Minn.) with transgenic plasma samples diluted 1:20,000 using the manufacturer described protocol. The results are presented in the Table below. The results indicate that treatment with ISIS oligonucleotides resulted in reduced ANGPTL3 protein levels.

TABLE 48

Percent inhibition of plasma protein levels in the transgenic mouse

| ISIS No | % | SEQ ID NO |
|---|---|---|
| 233710 | 96 | 233 |
| 337487 | 78 | 28 |
| 544145 | 96 | 16 |
| 544162 | 97 | 18 |
| 544199 | 98 | 20 |
| 560306 | 97 | 34 |
| 560400 | 98 | 35 |
| 560401 | 97 | 36 |
| 560402 | 94 | 37 |
| 560469 | 96 | 38 |
| 560735 | 91 | 49 |
| 567320 | 98 | 93 |
| 567321 | 96 | 94 |

Plasma Chemistry Markers

To evaluate the effect of ISIS oligonucleotides on day 8, plasma levels of transaminases (ALT and AST) were measured using an automated clinical chemistry analyzer (Hitachi Olympus AU400e, Melville, N.Y.). The results are presented in the Table below. ISIS oligonucleotides that caused changes in the levels of any of these liver function markers outside the expected range for antisense oligonucleotides were excluded in further studies.

TABLE 49

Plasma transaminase levels (IU/L) in transgenic mice on day 8

| | ALT | AST | SEQ ID NO |
|---|---|---|---|
| PBS | 29 | 44 | |
| ISIS 233710 | 29 | 47 | 233 |
| ISIS 337487 | 22 | 36 | 28 |
| ISIS 544145 | 29 | 45 | 16 |
| ISIS 544162 | 31 | 62 | 18 |
| ISIS 544199 | 29 | 51 | 20 |
| ISIS 560306 | 23 | 42 | 34 |
| ISIS 560400 | 24 | 52 | 35 |
| ISIS 560401 | 20 | 38 | 36 |
| ISIS 560402 | 29 | 49 | 37 |
| ISIS 560469 | 22 | 50 | 38 |
| ISIS 560735 | 20 | 38 | 49 |
| ISIS 567320 | 49 | 71 | 93 |
| ISIS 567321 | 20 | 44 | 94 |

Study 3

Male and female Tg mice were maintained on a 12-hour light/dark cycle. Animals were acclimated for at least 7 days in the research facility before initiation of the experiment. Antisense oligonucleotides (ASOs) were prepared in buffered saline (PBS) and sterilized by filtering through a 0.2 micron filter. Oligonucleotides were dissolved in 0.9% PBS for injection.

Groups of mice received intraperitoneal injections of 5-10-5 MOE gapmers at a dose of 2.5 mg/kg, 12.5 mg/kg, or 25 mg/kg once per week for 3 weeks. One group of mice received subcutaneous injections of PBS once weekly for 2 weeks. The PBS-injected groups served as the control groups to which the corresponding oligonucleotide-treated groups were compared.

RNA Analysis

At the end of the treatment period, RNA was extracted from liver for real-time PCR analysis of measurement of mRNA expression of ANGPTL3 with hANGPTL3_LTS01022 (forward sequence AAATTT-TAGCCAATGGCCTCC, designated herein as SEQ ID NO: 10; reverse sequence TGTCATTAATTTGGCCCTTCG, designated herein as SEQ ID NO: 11; probe sequence TCAGTTGGGACATGGTCTTAAAGACTTTGTCC, designated herein as SEQ ID NO: 12). Results are presented as percent change of mRNA, relative to PBS control, normalized with RIBOGREEN®. As shown in the Table below, treatment with ISIS antisense oligonucleotides resulted in significant reduction of ANGPTL3 mRNA in comparison to the PBS control. The $ED_{50}$ of each gapmer is also presented in the Table below. 'n.d.' indicates that the $ED_{50}$ could not be determined.

TABLE 50

Percent inhibition of ANGPTL3 mRNA in transgenic mouse liver relative to the PBS control

| ISIS No | Dose (mg/kg) | % | $ED_{50}$ | SEQ ID NO |
|---|---|---|---|---|
| 233710 | 25 | 88 | 8 | 233 |
| | 12.5 | 79 | | |
| | 2.5 | 0 | | |
| 544145 | 25 | 90 | 4 | 16 |
| | 12.5 | 74 | | |
| | 2.5 | 39 | | |
| 544162 | 25 | 53 | 9 | 18 |
| | 12.5 | 63 | | |
| | 2.5 | 39 | | |
| 544199 | 25 | 81 | 7 | 20 |
| | 12.5 | 82 | | |
| | 2.5 | 7 | | |
| 560306 | 25 | 0 | n.d. | 34 |
| | 12.5 | 0 | | |
| | 2.5 | 0 | | |
| 560400 | 25 | 87 | 5 | 35 |
| | 12.5 | 76 | | |
| | 2.5 | 24 | | |
| 560401 | 25 | 89 | 8 | 36 |
| | 12.5 | 62 | | |
| | 2.5 | 5 | | |
| 560469 | 25 | 73 | 3 | 38 |
| | 12.5 | 78 | | |
| | 2.5 | 50 | | |
| 560735 | 25 | 26 | 31 | 49 |
| | 12.5 | 37 | | |
| | 2.5 | 51 | | |
| 567320 | 25 | 74 | 12 | 93 |
| | 12.5 | 37 | | |
| | 2.5 | 32 | | |
| 567321 | 25 | 75 | 11 | 94 |
| | 12.5 | 61 | | |
| | 2.5 | 0 | | |

Protein Analysis

Human ANGPTL3 protein levels were quantified using a commercially available ELISA kit (Catalog #DANL30 by R&D Systems, Minneapolis, Minn.) with transgenic plasma samples diluted 1:20,000 using the manufacturer described protocol. The results are presented in the Table below. The results indicate that treatment with ISIS oligonucleotides resulted in reduced ANGPTL3 protein levels. 'n.d.' indicates that the $ED_{50}$ could not be determined.

TABLE 51

Percent inhibition of plasma protein levels in the transgenic mouse

| ISIS No | Dose (mg/kg) | % | ED50 | SEQ ID NO |
|---|---|---|---|---|
| 233710 | 25 | 80 | 11 | 233 |
|  | 12.5 | 56 |  |  |
|  | 2.5 | 0 |  |  |
| 544145 | 25 | 88 | 9 | 16 |
|  | 12.5 | 64 |  |  |
|  | 2.5 | 0 |  |  |
| 544162 | 25 | 56 | 15 | 18 |
|  | 12.5 | 46 |  |  |
|  | 2.5 | 24 |  |  |
| 544199 | 25 | 73 | 6 | 20 |
|  | 12.5 | 73 |  |  |
|  | 2.5 | 31 |  |  |
| 560306 | 25 | 63 | n.d. | 34 |
|  | 12.5 | 55 |  |  |
|  | 2.5 | 53 |  |  |
| 560400 | 25 | 88 | 6 | 35 |
|  | 12.5 | 73 |  |  |
|  | 2.5 | 20 |  |  |
| 560401 | 25 | 88 | 10 | 36 |
|  | 12.5 | 61 |  |  |
|  | 2.5 | 0 |  |  |
| 560469 | 25 | 75 | 4 | 38 |
|  | 12.5 | 70 |  |  |
|  | 2.5 | 52 |  |  |
| 560735 | 25 | 27 | 34 | 49 |
|  | 12.5 | 37 |  |  |
|  | 2.5 | 34 |  |  |
| 567320 | 25 | 69 | 10 | 93 |
|  | 12.5 | 44 |  |  |
|  | 2.5 | 39 |  |  |
| 567321 | 25 | 68 | 12 | 94 |
|  | 12.5 | 62 |  |  |
|  | 2.5 | 1 |  |  |

Plasma Chemistry Markers

To evaluate the effect of ISIS oligonucleotides on day 17, plasma levels of transaminases (ALT and AST) were measured using an automated clinical chemistry analyzer (Hitachi Olympus AU400e, Melville, N.Y.). The results are presented in the Table below. ISIS oligonucleotides that caused changes in the levels of any of these liver function markers outside the expected range for antisense oligonucleotides were excluded in further studies.

TABLE 52

Plasma transaminase levels (IU/L) in transgenic mice on day 17

| | Dose (mg/kg) | ALT | AST | SEQ ID NO |
|---|---|---|---|---|
| PBS | — | 25 | 38 |  |
| ISIS 233710 | 25 | 27 | 40 | 233 |
|  | 12.5 | 24 | 45 |  |
|  | 2.5 | 23 | 36 |  |
| ISIS 544145 | 25 | 30 | 56 | 16 |
|  | 12.5 | 25 | 52 |  |
|  | 2.5 | 28 | 43 |  |
| ISIS 544162 | 25 | 28 | 52 | 18 |
|  | 12.5 | 36 | 53 |  |
|  | 2.5 | 28 | 50 |  |
| ISIS 544199 | 25 | 24 | 47 | 20 |
|  | 12.5 | 23 | 60 |  |
|  | 2.5 | 24 | 44 |  |
| ISIS 560306 | 25 | 21 | 45 | 34 |
|  | 12.5 | 24 | 49 |  |
|  | 2.5 | 24 | 47 |  |
| ISIS 560400 | 25 | 22 | 38 | 35 |
|  | 12.5 | 21 | 53 |  |
|  | 2.5 | 23 | 52 |  |
| ISIS 560401 | 25 | 36 | 80 | 36 |
|  | 12.5 | 27 | 75 |  |
|  | 2.5 | 22 | 49 |  |
| ISIS 560469 | 25 | 24 | 121 | 38 |
|  | 12.5 | 23 | 53 |  |
|  | 2.5 | 21 | 88 |  |
| ISIS 560735 | 25 | 20 | 48 | 49 |
|  | 12.5 | 22 | 138 |  |
|  | 2.5 | 24 | 78 |  |
| ISIS 567320 | 25 | 21 | 65 | 93 |
|  | 12.5 | 20 | 58 |  |
|  | 2.5 | 23 | 46 |  |
| ISIS 567321 | 25 | 23 | 62 | 94 |
|  | 12.5 | 21 | 49 |  |
|  | 2.5 | 24 | 67 |  |

Study 4

Male and female Tg mice were maintained on a 12-hour light/dark cycle. Animals were acclimated for at least 7 days in the research facility before initiation of the experiment. Antisense oligonucleotides (ASOs) were prepared in buffered saline (PBS) and sterilized by filtering through a 0.2 micron filter. Oligonucleotides were dissolved in 0.9% PBS for injection.

Groups of mice received intraperitoneal injections of 5-10-5 MOE gapmers at a dose of 25 mg/kg once per week for 2 weeks. One group of mice received subcutaneous injections of PBS once weekly for 2 weeks. The PBS-injected group served as the control group to which the corresponding oligonucleotide-treated groups were compared.

RNA Analysis

At the end of the treatment period, RNA was extracted from liver for real-time PCR analysis of measurement of mRNA expression of ANGPTL3 with hANGPTL3_LTS01022. Results are presented as percent change of mRNA, relative to PBS control, normalized with RIBOGREEN. As shown in the Table below, treatment with ISIS antisense oligonucleotides resulted in significant reduction of ANGPTL3 mRNA in comparison to the PBS control.

TABLE 53

Percent inhibition of ANGPTL3 mRNA in transgenic mouse liver relative to the PBS control

| ISIS No | % | SEQ ID NO |
|---|---|---|
| 233710 | 68 | 233 |
| 544120 | 63 | 15 |
| 544199 | 82 | 20 |
| 544355 | 0 | 21 |
| 560268 | 36 | 32 |
| 560470 | 47 | 39 |
| 560471 | 67 | 40 |
| 560474 | 57 | 41 |
| 560566 | 45 | 42 |
| 560567 | 68 | 43 |
| 560607 | 37 | 46 |
| 560608 | 15 | 47 |
| 560744 | 25 | 51 |
| 560778 | 32 | 52 |
| 560811 | 27 | 54 |
| 560925 | 0 | 56 |
| 563639 | 5 | 79 |
| 567291 | 8 | 91 |

TABLE 53-continued

Percent inhibition of ANGPTL3 mRNA in transgenic mouse liver relative to the PBS control

| ISIS No | % | SEQ ID NO |
|---|---|---|
| 567330 | 30 | 95 |
| 568049 | 48 | 101 |
| 568146 | 26 | 104 |

Plasma Chemistry Markers

To evaluate the effect of ISIS oligonucleotides on day 10, plasma levels of transaminases (ALT and AST) were measured using an automated clinical chemistry analyzer (Hitachi Olympus AU400e, Melville, N.Y.). The results are presented in the Table below. ISIS oligonucleotides that caused changes in the levels of any of these liver function markers outside the expected range for antisense oligonucleotides were excluded in further studies.

TABLE 54

Plasma transaminase levels (IU/L) in transgenic mice on day 10

|  | ALT | AST | SEQ ID NO |
|---|---|---|---|
| PBS | 29 | 41 |  |
| ISIS 233710 | 29 | 48 | 233 |
| ISIS 544120 | 24 | 35 | 15 |
| ISIS 544199 | 27 | 57 | 20 |
| ISIS 544355 | 23 | 44 | 21 |
| ISIS 560268 | 23 | 42 | 32 |
| ISIS 560470 | 26 | 42 | 39 |
| ISIS 560471 | 21 | 50 | 40 |
| ISIS 560474 | 20 | 33 | 41 |
| ISIS 560566 | 27 | 102 | 42 |
| ISIS 560567 | 20 | 37 | 43 |
| ISIS 560607 | 25 | 47 | 46 |
| ISIS 560608 | 20 | 49 | 47 |
| ISIS 560744 | 26 | 66 | 51 |
| ISIS 560778 | 24 | 87 | 52 |
| ISIS 560811 | 21 | 63 | 54 |
| ISIS 560925 | 25 | 115 | 56 |
| ISIS 563639 | 20 | 43 | 79 |
| ISIS 567291 | 20 | 67 | 91 |
| ISIS 567330 | 29 | 78 | 95 |
| ISIS 568049 | 25 | 63 | 101 |
| ISIS 568146 | 28 | 140 | 104 |

Study 5

Male and female Tg mice were maintained on a 12-hour light/dark cycle. Animals were acclimated for at least 7 days in the research facility before initiation of the experiment. Antisense oligonucleotides (ASOs) were prepared in buffered saline (PBS) and sterilized by filtering through a 0.2 micron filter. Oligonucleotides were dissolved in 0.9% PBS for injection.

Groups of mice received intraperitoneal injections of 5-10-5 MOE gapmers or deoxy, MOE, and cEt gapmers at a dose of 25 mg/kg once per week for 2 weeks. One group of mice received subcutaneous injections of PBS once weekly for 2 weeks. The PBS-injected group served as the control group to which the corresponding oligonucleotide-treated groups were compared.

RNA Analysis

At the end of the treatment period, RNA was extracted from liver for real-time PCR analysis of measurement of mRNA expression of ANGPTL3 with RTS1984. Results are presented as percent change of mRNA, relative to PBS control, normalized with RIBOGREEN. As shown in the Table below, treatment with ISIS antisense oligonucleotides resulted in significant reduction of ANGPTL3 mRNA in comparison to the PBS control.

TABLE 55

Percent inhibition of ANGPTL3 mRNA in transgenic mouse liver relative to the PBS control

| ISIS No | Chemistry | % | SEQ ID NO |
|---|---|---|---|
| 233710 | 5-10-5 MOE | 79 | 233 |
| 544156 | 5-10-5 MOE | 92 | 17 |
| 559277 | Deoxy, MOE and cEt | 75 | 110 |
| 560265 | 5-10-5 MOE | 52 | 31 |
| 560285 | 5-10-5 MOE | 42 | 33 |
| 560574 | 5-10-5 MOE | 93 | 44 |
| 560847 | 5-10-5 MOE | 61 | 69 |
| 560992 | Deoxy, MOE and cEt | 80 | 112 |
| 561010 | Deoxy, MOE and cEt | 66 | 113 |
| 561011 | Deoxy, MOE and cEt | 96 | 114 |
| 561022 | Deoxy, MOE and cEt | 79 | 115 |
| 561025 | Deoxy, MOE and cEt | 57 | 116 |
| 563580 | 5-10-5 MOE | 80 | 77 |
| 567115 | 5-10-5 MOE | 78 | 88 |
| 567233 | 5-10-5 MOE | 91 | 90 |

Plasma Chemistry Markers

To evaluate the effect of ISIS oligonucleotides on day 9, plasma levels of transaminases (ALT and AST) were measured using an automated clinical chemistry analyzer (Hitachi Olympus AU400e, Melville, N.Y.). The results are presented in the Table below. ISIS oligonucleotides that caused changes in the levels of any of these liver function markers outside the expected range for antisense oligonucleotides were excluded in further studies.

TABLE 56

Plasma transaminase levels (IU/L) in transgenic mice on day 9

|  | Chemistry | ALT | AST | SEQ ID NO |
|---|---|---|---|---|
| PBS | — | 48 | 65 |  |
| ISIS 233710 | 5-10-5 MOE | 24 | 43 | 233 |
| ISIS 544156 | 5-10-5 MOE | 29 | 44 | 17 |
| ISIS 559277 | Deoxy, MOE and cEt | 22 | 38 | 110 |
| ISIS 560265 | 5-10-5 MOE | 28 | 83 | 31 |
| ISIS 560285 | 5-10-5 MOE | 29 | 44 | 33 |
| ISIS 560574 | 5-10-5 MOE | 24 | 54 | 44 |
| ISIS 560847 | 5-10-5 MOE | 25 | 45 | 69 |
| ISIS 560992 | Deoxy, MOE and cEt | 32 | 128 | 112 |
| ISIS 561010 | Deoxy, MOE and cEt | 22 | 51 | 113 |
| ISIS 561011 | Deoxy, MOE and cEt | 28 | 43 | 114 |
| ISIS 561022 | Deoxy, MOE and cEt | 51 | 85 | 115 |
| ISIS 561025 | Deoxy, MOE and cEt | 22 | 48 | 116 |
| ISIS 563580 | 5-10-5 MOE | 28 | 109 | 77 |
| ISIS 567115 | 5-10-5 MOE | 21 | 42 | 88 |
| ISIS 567233 | 5-10-5 MOE | 22 | 73 | 90 |

Study 6

Male and female Tg mice were maintained on a 12-hour light/dark cycle. Animals were acclimated for at least 7 days in the research facility before initiation of the experiment. Antisense oligonucleotides (ASOs) were prepared in buffered saline (PBS) and sterilized by filtering through a 0.2 micron filter. Oligonucleotides were dissolved in 0.9% PBS for injection.

Groups of mice received intraperitoneal injections of deoxy, MOE, and cEt oligonucleotides at a dose of 25 mg/kg once per week for 2 weeks. ISIS 233710, a 5-10-5 MOE gapmer, was also included as a benchmark. One group of mice received subcutaneous injections of PBS once weekly for 2 weeks. The PBS-injected group served as the control group to which the corresponding oligonucleotide-treated groups were compared.

RNA Analysis

At the end of the treatment period, RNA was extracted from liver for real-time PCR analysis of measurement of mRNA expression of ANGPTL3 with hANGPTL3_LTS01022. Results are presented as percent change of mRNA, relative to PBS control, normalized with RIBOGREEN. As shown in the Table below, treatment with several of the ISIS antisense oligonucleotides resulted in significant reduction of ANGPTL3 mRNA in comparison to the PBS control.

TABLE 57

Percent inhibition of ANGPTL3 mRNA in transgenic mouse liver relative to the PBS control

| ISIS No | Chemistry | % | SEQ ID NO |
|---|---|---|---|
| 233710 | 5-10-5 MOE | 68 | 233 |
| 561026 | Deoxy, MOE and cEt | 94 | 117 |
| 561079 | Deoxy, MOE and cEt | 51 | 160 |
| 561084 | Deoxy, MOE and cEt | 56 | 161 |
| 561123 | Deoxy, MOE and cEt | 47 | 163 |
| 561208 | Deoxy, MOE and cEt | 42 | 118 |
| 561241 | Deoxy, MOE and cEt | 13 | 164 |
| 561400 | Deoxy, MOE and cEt | 31 | 173 |
| 561418 | Deoxy, MOE and cEt | 32 | 169 |
| 561436 | Deoxy, MOE and cEt | 67 | 170 |
| 561443 | Deoxy, MOE and cEt | 12 | 171 |
| 561458 | Deoxy, MOE and cEt | 57 | 124 |

Protein Analysis

Human ANGPTL3 protein levels were quantified using a commercially available ELISA kit (Catalog #DANL30 by R&D Systems, Minneapolis, Minn.) with transgenic plasma samples diluted 1:20,000 using the manufacturer described protocol. The results are presented in the Table below. The results indicate that treatment with several of the ISIS oligonucleotides resulted in reduced ANGPTL3 protein levels.

TABLE 58

Percent inhibition of plasma protein levels in the transgenic mouse

| ISIS No | Chemistry | % | SEQ ID NO |
|---|---|---|---|
| 233710 | 5-10-5 MOE | 82 | 233 |
| 561026 | Deoxy, MOE and cEt | 92 | 117 |
| 561079 | Deoxy, MOE and cEt | 80 | 160 |
| 561084 | Deoxy, MOE and cEt | 89 | 161 |
| 561123 | Deoxy, MOE and cEt | 62 | 163 |
| 561208 | Deoxy, MOE and cEt | 0 | 118 |
| 561241 | Deoxy, MOE and cEt | 36 | 164 |
| 561400 | Deoxy, MOE and cEt | 60 | 173 |
| 561418 | Deoxy, MOE and cEt | 42 | 169 |
| 561436 | Deoxy, MOE and cEt | 46 | 170 |
| 561443 | Deoxy, MOE and cEt | 27 | 171 |
| 561458 | Deoxy, MOE and cEt | 71 | 124 |

Plasma Chemistry Markers

To evaluate the effect of ISIS oligonucleotides on day 10, plasma levels of transaminases (ALT and AST) were measured using an automated clinical chemistry analyzer (Hitachi Olympus AU400e, Melville, N.Y.). The results are presented in the Table below. ISIS oligonucleotides that caused changes in the levels of any of these liver function markers outside the expected range for antisense oligonucleotides were excluded in further studies.

TABLE 59

Plasma transaminase levels (IU/L) in transgenic mice on day 10

| | Chemistry | ALT | AST | SAE ID NO |
|---|---|---|---|---|
| PBS | — | 41 | 64 | |
| ISIS 233710 | 5-10-5 MOE | 25 | 74 | 233 |
| ISIS 561026 | Deoxy, MOE and cEt | 30 | 67 | 117 |
| ISIS 561079 | Deoxy, MOE and cEt | 42 | 62 | 160 |
| ISIS 561084 | Deoxy, MOE and cEt | 70 | 101 | 161 |
| ISIS 561123 | Deoxy, MOE and cEt | 24 | 41 | 163 |
| ISIS 561208 | Deoxy, MOE and cEt | 203 | 168 | 118 |
| ISIS 561241 | Deoxy, MOE and cEt | 26 | 47 | 164 |
| ISIS 561400 | Deoxy, MOE and cEt | 27 | 83 | 173 |
| ISIS 561418 | Deoxy, MOE and cEt | 58 | 164 | 169 |
| ISIS 561436 | Deoxy, MOE and cEt | 24 | 42 | 170 |
| ISIS 561443 | Deoxy, MOE and cEt | 27 | 91 | 171 |
| ISIS 561458 | Deoxy, MOE and cEt | 30 | 144 | 124 |

Study 7

Male and female Tg mice were maintained on a 12-hour light/dark cycle. Animals were acclimated for at least 7 days in the research facility before initiation of the experiment. Antisense oligonucleotides (ASOs) were prepared in buffered saline (PBS) and sterilized by filtering through a 0.2 micron filter. Oligonucleotides were dissolved in 0.9% PBS for injection.

Groups of mice received intraperitoneal injections of deoxy, MOE, and cEt oligonucleotides at a dose of 25 mg/kg once per week for 2 weeks. ISIS 233710, a 5-10-5 MOE gapmer, was also included as a benchmark. One group of mice received subcutaneous injections of PBS once weekly for 2 weeks. The PBS-injected group served as the control group to which the corresponding oligonucleotide-treated groups were compared.

RNA Analysis

At the end of the treatment period, RNA was extracted from liver for real-time PCR analysis of measurement of mRNA expression of ANGPTL3 with hANGPTL3_LTS01022. Results are presented as percent change of mRNA, relative to PBS control, normalized with RIBOGREEN. As shown in the Table below, treatment with ISIS antisense oligonucleotides resulted in significant reduction of ANGPTL3 mRNA in comparison to the PBS control.

TABLE 60

Percent inhibition of ANGPTL3 mRNA in transgenic mouse liver relative to the PBS control

| ISIS No | Chemistry | % | SEQ ID NO |
|---|---|---|---|
| 233710 | 5-10-5 MOE | 80 | 233 |
| 561462 | Deoxy, MOE and cEt | 84 | 126 |
| 561463 | Deoxy, MOE and cEt | 84 | 127 |
| 561486 | Deoxy, MOE and cEt | 74 | 130 |
| 561487 | Deoxy, MOE and cEt | 82 | 131 |
| 561504 | Deoxy, MOE and cEt | 51 | 133 |
| 561528 | Deoxy, MOE and cEt | 87 | 174 |
| 561565 | Deoxy, MOE and cEt | 94 | 175 |
| 561566 | Deoxy, MOE and cEt | 76 | 176 |
| 561571 | Deoxy, MOE and cEt | 51 | 178 |
| 561621 | Deoxy, MOE and cEt | 93 | 134 |
| 561646 | Deoxy, MOE and cEt | 39 | 140 |
| 561649 | Deoxy, MOE and cEt | 93 | 141 |
| 561650 | Deoxy, MOE and cEt | 82 | 142 |
| 561689 | Deoxy, MOE and cEt | 51 | 180 |
| 561722 | Deoxy, MOE and cEt | 88 | 183 |

TABLE 60-continued

Percent inhibition of ANGPTL3 mRNA in transgenic mouse liver relative to the PBS control

| ISIS No | Chemistry | % | SEQ ID NO |
|---|---|---|---|
| 561723 | Deoxy, MOE and cEt | 85 | 184 |
| 561770 | Deoxy, MOE and cEt | 70 | 143 |
| 562024 | Deoxy, MOE and cEt | 82 | 189 |

Protein Analysis

Human ANGPTL3 protein levels were quantified using a commercially available ELISA kit (Catalog #DANL30 by R&D Systems, Minneapolis, Minn.) with transgenic plasma samples diluted 1:20,000 using the manufacturer described protocol. The results are presented in the Table below. The results indicate that treatment with some of the ISIS oligonucleotides resulted in reduced ANGPTL3 levels. In this case, '0' value implies that treatment with the ISIS oligonucleotide did not inhibit expression; in some instances, increased levels of expression may have been recorded.

TABLE 61

Percent inhibition of plasma protein levels in the transgenic mouse

| ISIS No | Chemistry | % | SEQ ID NO |
|---|---|---|---|
| 233710 | 5-10-5 MOE | 60 | 233 |
| 561462 | Deoxy, MOE and cEt | 62 | 126 |
| 561463 | Deoxy, MOE and cEt | 59 | 127 |
| 561486 | Deoxy, MOE and cEt | 0 | 130 |
| 561487 | Deoxy, MOE and cEt | 0 | 131 |
| 561504 | Deoxy, MOE and cEt | 0 | 133 |
| 561528 | Deoxy, MOE and cEt | 0 | 174 |
| 561565 | Deoxy, MOE and cEt | 71 | 175 |
| 561566 | Deoxy, MOE and cEt | 0 | 176 |
| 561571 | Deoxy, MOE and cEt | 0 | 178 |
| 561621 | Deoxy, MOE and cEt | 72 | 134 |
| 561646 | Deoxy, MOE and cEt | 0 | 140 |
| 561649 | Deoxy, MOE and cEt | 63 | 141 |
| 561650 | Deoxy, MOE and cEt | 0 | 142 |
| 561689 | Deoxy, MOE and cEt | 0 | 180 |
| 561722 | Deoxy, MOE and cEt | 0 | 183 |
| 561723 | Deoxy, MOE and cEt | 0 | 184 |
| 561770 | Deoxy, MOE and cEt | 0 | 143 |
| 562024 | Deoxy, MOE and cEt | 0 | 189 |

Plasma Chemistry Markers

To evaluate the effect of ISIS oligonucleotides on day 9, plasma levels of transaminases (ALT and AST) were measured using an automated clinical chemistry analyzer (Hitachi Olympus AU400e, Melville, N.Y.). The results are presented in the Table below. ISIS oligonucleotides that caused changes in the levels of any of these liver function markers outside the expected range for antisense oligonucleotides were excluded in further studies.

TABLE 62

Plasma transaminase levels (IU/L) in transgenic mice on day 9

|  | Chemistry | ALT | AST | SEQ ID NO |
|---|---|---|---|---|
| PBS | — | 35 | 72 |  |
| ISIS 233710 | 5-10-5 MOE | 23 | 39 | 233 |
| ISIS 561462 | Deoxy, MOE and cEt | 26 | 56 | 126 |
| ISIS 561463 | Deoxy, MOE and cEt | 34 | 61 | 127 |
| ISIS 561486 | Deoxy, MOE and cEt | 23 | 61 | 130 |
| ISIS 561487 | Deoxy, MOE and cEt | 21 | 64 | 131 |

TABLE 62-continued

Plasma transaminase levels (IU/L) in transgenic mice on day 9

|  | Chemistry | ALT | AST | SEQ ID NO |
|---|---|---|---|---|
| ISIS 561504 | Deoxy, MOE and cEt | 26 | 66 | 133 |
| ISIS 561528 | Deoxy, MOE and cEt | 26 | 86 | 174 |
| ISIS 561565 | Deoxy, MOE and cEt | 24 | 43 | 175 |
| ISIS 561566 | Deoxy, MOE and cEt | 23 | 62 | 176 |
| ISIS 561571 | Deoxy, MOE and cEt | 26 | 68 | 178 |
| ISIS 561621 | Deoxy, MOE and cEt | 26 | 96 | 134 |
| ISIS 561646 | Deoxy, MOE and cEt | 24 | 77 | 140 |
| ISIS 561649 | Deoxy, MOE and cEt | 22 | 94 | 141 |
| ISIS 561650 | Deoxy, MOE and cEt | 34 | 121 | 142 |
| ISIS 561689 | Deoxy, MOE and cEt | 24 | 73 | 180 |
| ISIS 561722 | Deoxy, MOE and cEt | 34 | 89 | 183 |
| ISIS 561723 | Deoxy, MOE and cEt | 24 | 65 | 184 |
| ISIS 561770 | Deoxy, MOE and cEt | 22 | 69 | 143 |
| ISIS 562024 | Deoxy, MOE and cEt | 32 | 162 | 189 |

Study 8

Male and female Tg mice were maintained on a 12-hour light/dark cycle. Animals were acclimated for at least 7 days in the research facility before initiation of the experiment. Antisense oligonucleotides (ASOs) were prepared in buffered saline (PBS) and sterilized by filtering through a 0.2 micron filter. Oligonucleotides were dissolved in 0.9% PBS for injection.

Groups of mice received intraperitoneal injections of deoxy, MOE, and cEt oligonucleotides at a dose of 25 mg/kg once per week for 2 weeks. ISIS 233710, a 5-10-5 MOE gapmer, was also included as a benchmark. One group of mice received subcutaneous injections of PBS once weekly for 2 weeks. The PBS-injected group served as the control group to which the corresponding oligonucleotide-treated groups were compared.

RNA Analysis

At the end of the treatment period, RNA was extracted from liver for real-time PCR analysis of measurement of mRNA expression of ANGPTL3 with hANGPTL3_LTS01022. Results are presented as percent change of mRNA, relative to PBS control, normalized with RIBOGREEN. As shown in the Table below, treatment with ISIS antisense oligonucleotides resulted in significant reduction of ANGPTL3 mRNA in comparison to the PBS control.

TABLE 63

Percent inhibition of ANGPTL3 mRNA in transgenic mouse liver relative to the PBS control

| ISIS No | Chemistry | % | SEQ ID NO |
|---|---|---|---|
| 233710 | 5-10-5 MOE | 99 | 233 |
| 562078 | Deoxy, MOE and cEt | 73 | 147 |
| 562086 | Deoxy, MOE and cEt | 85 | 148 |
| 562103 | Deoxy, MOE and cEt | 58 | 149 |
| 562110 | Deoxy, MOE and cEt | 94 | 150 |
| 562155 | Deoxy, MOE and cEt | 85 | 192 |
| 562181 | Deoxy, MOE and cEt | 79 | 195 |
| 562433 | Deoxy, MOE and cEt | 59 | 155 |
| 562436 | Deoxy, MOE and cEt | 99 | 156 |
| 586669 | Deoxy, MOE and cEt | 95 | 210 |
| 586676 | Deoxy, MOE and cEt | 80 | 211 |

Protein Analysis

Human ANGPTL3 protein levels were quantified using a commercially available ELISA kit (Catalog #DANL30 by R&D Systems, Minneapolis, Minn.) with transgenic plasma samples diluted 1:20,000 using the manufacturer described protocol. The results are presented in the Table below. The results indicate that treatment with the ISIS oligonucleotides resulted in reduced ANGPTL3 levels.

TABLE 64

Percent inhibition of plasma protein levels in the transgenic mouse

| ISIS No | Chemistry | % | SEQ ID NO |
|---|---|---|---|
| 233710 | 5-10-5 MOE | 69 | 233 |
| 562078 | Deoxy, MOE and cEt | 44 | 147 |
| 562086 | Deoxy, MOE and cEt | 91 | 148 |
| 562103 | Deoxy, MOE and cEt | 26 | 149 |
| 562110 | Deoxy, MOE and cEt | 68 | 150 |
| 562155 | Deoxy, MOE and cEt | 75 | 192 |
| 562181 | Deoxy, MOE and cEt | 86 | 195 |
| 562433 | Deoxy, MOE and cEt | 80 | 155 |
| 562436 | Deoxy, MOE and cEt | 98 | 156 |
| 586669 | Deoxy, MOE and cEt | 98 | 210 |
| 586676 | Deoxy, MOE and cEt | 95 | 211 |

Plasma Chemistry Markers

To evaluate the effect of ISIS oligonucleotides on day 8, plasma levels of transaminases (ALT and AST) were measured using an automated clinical chemistry analyzer (Hitachi Olympus AU400e, Melville, N.Y.). The results are presented in the Table below. ISIS oligonucleotides that caused changes in the levels of any of these liver function markers outside the expected range for antisense oligonucleotides were excluded in further studies.

TABLE 65

Plasma transaminase levels (IU/L) in transgenic mice on day 8

| | Chemistry | ALT | AST | SEQ ID NO |
|---|---|---|---|---|
| PBS | — | 44 | 248 | |
| ISIS 233710 | 5-10-5 MOE | 27 | 52 | 233 |
| ISIS 562078 | Deoxy, MOE and cEt | 41 | 130 | 147 |
| ISIS 562086 | Deoxy, MOE and cEt | 30 | 62 | 148 |
| ISIS 562103 | Deoxy, MOE and cEt | 35 | 99 | 149 |
| ISIS 562110 | Deoxy, MOE and cEt | 30 | 161 | 150 |
| ISIS 562155 | Deoxy, MOE and cEt | 68 | 622 | 192 |
| ISIS 562181 | Deoxy, MOE and cEt | 37 | 168 | 195 |
| ISIS 562433 | Deoxy, MOE and cEt | 33 | 209 | 155 |
| ISIS 562436 | Deoxy, MOE and cEt | 30 | 93 | 156 |
| ISIS 586669 | Deoxy, MOE and cEt | 27 | 141 | 210 |
| ISIS 586676 | Deoxy, MOE and cEt | 22 | 60 | 211 |

Study 9

Male and female Tg mice were maintained on a 12-hour light/dark cycle. Animals were acclimated for at least 7 days in the research facility before initiation of the experiment. Antisense oligonucleotides (ASOs) were prepared in buffered saline (PBS) and sterilized by filtering through a 0.2 micron filter. Oligonucleotides were dissolved in 0.9% PBS for injection.

Groups of mice received intraperitoneal injections of deoxy, MOE, and cEt oligonucleotides at a dose of 25 mg/kg once per week for 2 weeks. ISIS 233710, a 5-10-5 MOE gapmer, was also included as a benchmark. One group of mice received subcutaneous injections of PBS once weekly for 2 weeks. The PBS-injected group served as the control group to which the corresponding oligonucleotide-treated groups were compared.

RNA Analysis

At the end of the treatment period, RNA was extracted from liver for real-time PCR analysis of measurement of mRNA expression of ANGPTL3 with hANGPTL3_LTS01022. Results are presented as percent change of mRNA, relative to PBS control, normalized with RIBOGREEN. As shown in the Table below, treatment with some of the ISIS antisense oligonucleotides resulted in significant reduction of ANGPTL3 mRNA in comparison to the PBS control. In this case, '0' value implies that treatment with the ISIS oligonucleotide did not inhibit expression; in some instances, increased levels of expression may have been recorded.

TABLE 66

Percent inhibition of ANGPTL3 mRNA in transgenic mouse liver relative to the PBS control

| ISIS No | Chemistry | % | SEQ ID NO |
|---|---|---|---|
| 233710 | 5-10-5 MOE | 84 | 233 |
| 586690 | Deoxy, MOE and cEt | 45 | 213 |
| 586692 | Deoxy, MOE and cEt | 45 | 220 |
| 586700 | Deoxy, MOE and cEt | 46 | 221 |
| 586707 | Deoxy, MOE and cEt | 88 | 218 |
| 586708 | Deoxy, MOE and cEt | 73 | 222 |
| 586718 | Deoxy, MOE and cEt | 20 | 219 |
| 586744 | Deoxy, MOE and cEt | 0 | 223 |
| 586745 | Deoxy, MOE and cEt | 0 | 224 |
| 586755 | Deoxy, MOE and cEt | 75 | 226 |
| 586761 | Deoxy, MOE and cEt | 66 | 227 |
| 586787 | Deoxy, MOE and cEt | 47 | 228 |
| 586796 | Deoxy, MOE and cEt | 88 | 229 |
| 586797 | Deoxy, MOE and cEt | 81 | 230 |
| 586802 | Deoxy, MOE and cEt | 33 | 231 |
| 586804 | Deoxy, MOE and cEt | 60 | 232 |

Protein Analysis

Human ANGPTL3 protein levels were quantified using a commercially available ELISA kit (Catalog #DANL30 by R&D Systems, Minneapolis, Minn.) with transgenic plasma samples diluted 1:20,000 using the manufacturer described protocol. The results are presented in the Table below. The results indicate that treatment with some of the ISIS oligonucleotides resulted in reduced ANGPTL3 levels. In this case, '0' value implies that treatment with the ISIS oligonucleotide did not inhibit expression; in some instances, increased levels of expression may have been recorded.

TABLE 67

Percent inhibition of plasma protein levels in the transgenic mouse

| ISIS No | Chemistry | % | SEQ ID NO |
|---|---|---|---|
| 233710 | 5-10-5 MOE | 80 | 233 |
| 586690 | Deoxy, MOE and cEt | 21 | 213 |
| 586692 | Deoxy, MOE and cEt | 46 | 220 |
| 586700 | Deoxy, MOE and cEt | 0 | 221 |
| 586707 | Deoxy, MOE and cEt | 84 | 218 |
| 586708 | Deoxy, MOE and cEt | 32 | 222 |
| 586718 | Deoxy, MOE and cEt | 0 | 219 |
| 586744 | Deoxy, MOE and cEt | 0 | 223 |
| 586745 | Deoxy, MOE and cEt | 0 | 224 |
| 586755 | Deoxy, MOE and cEt | 0 | 226 |
| 586761 | Deoxy, MOE and cEt | 0 | 227 |
| 586787 | Deoxy, MOE and cEt | 0 | 228 |
| 586796 | Deoxy, MOE and cEt | 40 | 229 |
| 586797 | Deoxy, MOE and cEt | 50 | 230 |
| 586802 | Deoxy, MOE and cEt | 0 | 231 |
| 586804 | Deoxy, MOE and cEt | 0 | 232 |

Plasma Chemistry Markers

To evaluate the effect of ISIS oligonucleotides on day 9, plasma levels of transaminases (ALT and AST) were measured using an automated clinical chemistry analyzer (Hitachi Olympus AU400e, Melville, N.Y.). The results are presented in the Table below. ISIS oligonucleotides that caused changes in the levels of any of these liver function markers outside the expected range for antisense oligonucleotides were excluded in further studies.

TABLE 68

Plasma transaminase levels (IU/L) in transgenic mice on day 9

|  | Chemistry | ALT | AST | SEQ ID NO |
|---|---|---|---|---|
| PBS | — | 28 | 73 |  |
| ISIS 233710 | 5-10-5 MOE | 22 | 86 | 233 |
| ISIS 586690 | Deoxy, MOE and cEt | 42 | 120 | 213 |
| ISIS 586692 | Deoxy, MOE and cEt | 22 | 45 | 220 |
| ISIS 586700 | Deoxy, MOE and cEt | 24 | 84 | 221 |
| ISIS 586707 | Deoxy, MOE and cEt | 26 | 44 | 218 |
| ISIS 586708 | Deoxy, MOE and cEt | 22 | 48 | 222 |
| ISIS 586718 | Deoxy, MOE and cEt | 22 | 39 | 219 |
| ISIS 586744 | Deoxy, MOE and cEt | 26 | 83 | 223 |
| ISIS 586745 | Deoxy, MOE and cEt | 25 | 56 | 224 |
| ISIS 586746 | Deoxy, MOE and cEt | 77 | 77 | 225 |
| ISIS 586755 | Deoxy, MOE and cEt | 28 | 148 | 226 |
| ISIS 586761 | Deoxy, MOE and cEt | 36 | 126 | 227 |
| ISIS 586787 | Deoxy, MOE and cEt | 23 | 88 | 228 |
| ISIS 586796 | Deoxy, MOE and cEt | 32 | 148 | 229 |
| ISIS 586797 | Deoxy, MOE and cEt | 29 | 151 | 230 |
| ISIS 586802 | Deoxy, MOE and cEt | 35 | 200 | 231 |
| ISIS 586804 | Deoxy, MOE and cEt | 24 | 87 | 232 |

Study 10

Male and female Tg mice were maintained on a 12-hour light/dark cycle. Animals were acclimated for at least 7 days in the research facility before initiation of the experiment. Antisense oligonucleotides (ASOs) were prepared in buffered saline (PBS) and sterilized by filtering through a 0.2 micron filter. Oligonucleotides were dissolved in 0.9% PBS for injection.

Groups of mice received intraperitoneal injections of 5-10-5 MOE gapmers or deoxy, MOE and cEt oligonucleotides at a dose of 5 mg/kg, 12.5 mg/kg, or 25 mg/kg once per week for 2 weeks. One group of mice received subcutaneous injections of PBS once weekly for 2 weeks. The PBS-injected group served as the control group to which the corresponding oligonucleotide-treated groups were compared.

RNA Analysis

At the end of the treatment period, RNA was extracted from liver for real-time PCR analysis of measurement of mRNA expression of ANGPTL3 with hANGPTL3_LTS01022, and also with RTS3492_MGB. Results are presented as percent change of mRNA, relative to PBS control, normalized with RIBOGREEN®. As shown in the Table below, treatment with some of the ISIS antisense oligonucleotides resulted in reduction of ANGPTL3 mRNA in comparison to the PBS control.

TABLE 69

Percent inhibition of ANGPTL3 mRNA in transgenic mouse liver relative to the PBS control

| ISIS No | Chemistry | Dose (mg/kg) | RTS3492_MGB | hANGPTL3_LTS01022 | SEQ ID NO |
|---|---|---|---|---|---|
| 233710 | 5-10-5 MOE | 25 | 0 | 8 | 233 |
|  |  | 12.5 | 24 | 22 |  |
|  |  | 5 | 12 | 22 |  |
| 544199 | 5-10-5 MOE | 25 | 63 | 59 | 20 |
|  |  | 12.5 | 43 | 43 |  |
|  |  | 5 | 17 | 24 |  |
| 559277 | Deoxy, MOE and cEt | 25 | 37 | 46 | 110 |
|  |  | 12.5 | 0 | 0 |  |
|  |  | 5 | 0 | 0 |  |
| 560400 | 5-10-5 MOE | 25 | 45 | 48 | 35 |
|  |  | 12.5 | 36 | 50 |  |
|  |  | 5 | 0 | 0 |  |
| 561010 | Deoxy, MOE and cEt | 25 | 5 | 37 | 113 |
|  |  | 12.5 | 0 | 6 |  |
|  |  | 5 | 0 | 0 |  |
| 563580 | 5-10-5 MOE | 25 | 56 | 59 | 77 |
|  |  | 12.5 | 43 | 44 |  |
|  |  | 5 | 5 | 9 |  |
| 567320 | 5-10-5 MOE | 25 | 47 | 50 | 93 |
|  |  | 12.5 | 0 | 0 |  |
|  |  | 5 | 0 | 0 |  |
| 567321 | 5-10-5 MOE | 25 | 46 | 32 | 94 |
|  |  | 12.5 | 0 | 0 |  |
|  |  | 5 | 0 | 0 |  |

Plasma Chemistry Markers

To evaluate the effect of ISIS oligonucleotides on day 8, plasma levels of transaminases (ALT and AST) were measured using an automated clinical chemistry analyzer (Hitachi Olympus AU400e, Melville, N.Y.). The results are presented in the Table below. ISIS oligonucleotides that caused changes in the levels of any of these liver function markers outside the expected range for antisense oligonucleotides were excluded in further studies.

TABLE 70

Plasma transaminase levels (IU/L) in transgenic mice on day 8

|  | Chemistry | Dose (mg/kg) | ALT | AST | SEQ ID NO |
|---|---|---|---|---|---|
| PBS | — | — | 22 | 82 |  |
| ISIS 233710 | 5-10-5 MOE | 25 | 21 | 41 | 233 |
|  |  | 12.5 | 23 | 66 |  |
|  |  | 5 | 22 | 118 |  |
| ISIS 544199 | 5-10-5 MOE | 25 | 25 | 47 | 20 |
|  |  | 12.5 | 20 | 40 |  |
|  |  | 5 | 27 | 43 |  |
| ISIS 559277 | Deoxy, MOE and cEt | 25 | 21 | 34 | 110 |
|  |  | 12.5 | 21 | 37 |  |
|  |  | 5 | 22 | 39 |  |
| ISIS 560400 | 5-10-5 MOE | 25 | 21 | 37 | 35 |
|  |  | 12.5 | 20 | 44 |  |
|  |  | 5 | 24 | 35 |  |
| ISIS 561010 | Deoxy, MOE and cEt | 25 | 22 | 48 | 113 |
|  |  | 12.5 | 33 | 64 |  |
|  |  | 5 | 24 | 41 |  |
| ISIS 563580 | 5-10-5 MOE | 25 | 21 | 36 | 77 |
|  |  | 12.5 | 29 | 81 |  |
|  |  | 5 | 21 | 59 |  |
| ISIS 567320 | 5-10-5 MOE | 25 | 22 | 47 | 93 |
|  |  | 12.5 | 29 | 58 |  |
|  |  | 5 | 21 | 70 |  |
| ISIS 567321 | 5-10-5 MOE | 25 | 20 | 50 | 94 |
|  |  | 12.5 | 24 | 102 |  |
|  |  | 5 | 19 | 53 |  |

Example 12: Tolerability of Antisense Oligonucleotides Targeting Human ANGPTL3 in CD1 Mice CD1® mice (Charles River, Mass.) are a multipurpose mice model, frequently utilized for safety and efficacy testing. The mice were treated with ISIS antisense oligonucleotides selected from studies described above and evaluated for changes in the levels of various plasma chemistry markers.

Study 1

Male CD1 mice (one animal per treatment group) were injected intraperitoneally with a single dose of 200 mg/kg of deoxy, MOE, and cEt oligonucleotide. One male CD1 mouse was injected subcutaneously with a single dose of PBS. Mice were euthanized 48 hours after the last dose, and organs and plasma were harvested for further analysis.

Plasma Chemistry Markers

To evaluate the effect of ISIS oligonucleotides on day 4 plasma levels of transaminases (ALT and AST) were measured using an automated clinical chemistry analyzer (Hitachi Olympus AU400e, Melville, N.Y.). The results are presented in the Table below. ISIS oligonucleotides that caused changes in the levels of any of these liver function markers outside the expected range for antisense oligonucleotides were excluded in further studies.

TABLE 71

Plasma transaminase levels in CD1 mice plasma on day 4

|  | ALT (IU/L) | AST (IU/L) | SEQ ID NO |
|---|---|---|---|
| ISIS 559277 | 29 | 43 | 110 |
| ISIS 560990 | 19 | 43 | 111 |
| ISIS 560992 | 21 | 36 | 112 |
| ISIS 561010 | 31 | 40 | 113 |
| ISIS 561011 | 27 | 32 | 114 |
| ISIS 561022 | 35 | 48 | 115 |
| ISIS 561025 | 17 | 28 | 116 |
| ISIS 561026 | 31 | 43 | 117 |
| ISIS 561208 | 32 | 47 | 118 |
| ISIS 561320 | 25 | 37 | 119 |
| ISIS 561343 | 41 | 90 | 120 |
| ISIS 561345 | 30 | 45 | 121 |
| ISIS 561347 | 31 | 41 | 122 |
| ISIS 561458 | 18 | 38 | 124 |
| ISIS 561460 | 42 | 59 | 125 |
| ISIS 561463 | 21 | 33 | 127 |
| ISIS 561486 | 17 | 39 | 130 |
| ISIS 561487 | 18 | 39 | 131 |
| ISIS 561504 | 24 | 41 | 133 |
| ISIS 561621 | 31 | 56 | 134 |

Body Weights

Body weights were measured one day after the single dose of ISIS oligonucleotide, and are presented in the Table below. ISIS oligonucleotides that caused any changes in organ weights outside the expected range for antisense oligonucleotides were excluded from further studies.

TABLE 72

Body weights (g) of CD1 mice after antisense oligonucleotide treatment

|  | Body weight | SEQ ID NO |
|---|---|---|
| ISIS 559277 | 27 | 110 |
| ISIS 560990 | 28 | 111 |
| ISIS 560992 | 29 | 112 |
| ISIS 561010 | 30 | 113 |
| ISIS 561011 | 27 | 114 |
| ISIS 561022 | 24 | 115 |
| ISIS 561025 | 28 | 116 |
| ISIS 561026 | 27 | 117 |
| ISIS 561208 | 29 | 118 |
| ISIS 561320 | 27 | 119 |
| ISIS 561343 | 24 | 120 |
| ISIS 561345 | 25 | 121 |
| ISIS 561347 | 28 | 122 |
| ISIS 561458 | 25 | 124 |
| ISIS 561460 | 26 | 125 |
| ISIS 561463 | 26 | 127 |
| ISIS 561486 | 26 | 130 |
| ISIS 561487 | 27 | 131 |
| ISIS 561504 | 26 | 133 |
| ISIS 561621 | 27 | 134 |

Study 2

Male CD1 mice (one animal per treatment group) were injected intraperitoneally with a single dose of 200 mg/kg of deoxy, MOE and cEt oligonucleotides. One male CD1 mouse was injected subcutaneously with a single dose of PBS. Mice were euthanized 48 hours after the last dose, and organs and plasma were harvested for further analysis.

Plasma Chemistry Markers

To evaluate the effect of ISIS oligonucleotides on day 5 plasma levels of transaminases (ALT and AST) were measured using an automated clinical chemistry analyzer (Hitachi Olympus AU400e, Melville, N.Y.). The results are presented in the Table below. ISIS oligonucleotides that caused changes in the levels of any of these liver function markers outside the expected range for antisense oligonucleotides were excluded in further studies.

TABLE 73

Plasma transaminase levels in CD1 mice plasma on day 5

|  | ALT (IU/L) | AST (IU/L) | SEQ ID NO |
|---|---|---|---|
| ISIS 561622 | 29 | 64 | 136 |
| ISIS 561628 | 17 | 24 | 137 |
| ISIS 561646 | 16 | 34 | 140 |
| ISIS 561650 | 32 | 51 | 142 |
| ISIS 561079 | 19 | 32 | 160 |
| ISIS 561084 | 24 | 56 | 161 |
| ISIS 561241 | 60 | 70 | 164 |
| ISIS 561462 | 22 | 54 | 126 |
| ISIS 561649 | 56 | 53 | 141 |
| ISIS 561770 | 23 | 39 | 143 |
| ISIS 561781 | 20 | 41 | 144 |
| ISIS 561918 | 31 | 112 | 146 |
| ISIS 562078 | 15 | 33 | 147 |
| ISIS 562086 | 19 | 32 | 148 |
| ISIS 562110 | 20 | 41 | 150 |
| ISIS 562415 | 13 | 30 | 154 |
| ISIS 562433 | 19 | 35 | 155 |
| ISIS 562436 | 21 | 37 | 156 |
| ISIS 562442 | 19 | 34 | 158 |

Body Weights

Body weights were measured on day 5 after the single dose of ISIS oligonucleotide, and are presented in the Table below. ISIS oligonucleotides that caused any changes in organ weights outside the expected range for antisense oligonucleotides were excluded from further studies.

TABLE 74

Body weights (g) of CD1 mice after antisense oligonucleotide treatment

|  | Body weights | SEQ ID NO |
|---|---|---|
| ISIS 561622 | 27 | 136 |
| ISIS 561628 | 28 | 137 |
| ISIS 561646 | 29 | 140 |
| ISIS 561650 | 30 | 142 |
| ISIS 561079 | 27 | 160 |
| ISIS 561084 | 24 | 161 |
| ISIS 561241 | 28 | 164 |
| ISIS 561462 | 27 | 126 |
| ISIS 561649 | 29 | 141 |
| ISIS 561770 | 27 | 143 |
| ISIS 561781 | 24 | 144 |
| ISIS 561918 | 25 | 146 |
| ISIS 562078 | 28 | 147 |
| ISIS 562086 | 25 | 148 |
| ISIS 562110 | 26 | 150 |
| ISIS 562415 | 26 | 154 |
| ISIS 562433 | 26 | 155 |
| ISIS 562436 | 27 | 156 |
| ISIS 562442 | 26 | 158 |

Study 3

Male CD1 mice (four animals per treatment group) were injected intraperitoneally with 100 mg/kg of 5-10-5 MOE gapmers given once a week for 6 weeks. One group of 4 male CD1 mice was injected intraperitoneally with PBS given once a week for 6 weeks. Mice were euthanized 48 hours after the last dose, and organs and plasma were harvested for further analysis.

Plasma Chemistry Markers

To evaluate the effect of ISIS oligonucleotides, plasma levels of various liver and kidney function markers were measured on day 45 using an automated clinical chemistry analyzer (Hitachi Olympus AU400e, Melville, N.Y.). The results are presented in the Table below. ISIS oligonucleotides that caused changes in the levels of any of these markers outside the expected range for antisense oligonucleotides were excluded in further studies.

TABLE 75

Plasma chemistry marker levels in CD1 mice plasma on day 45

|  | ALT (IU/L) | AST (IU/L) | Albumin (g/dL) | BUN (mg/dL) | Creatinine (mg/dL) | Bilurubin (mg/dL) | SEQ ID NO |
|---|---|---|---|---|---|---|---|
| PBS | 30 | 55 | 2.7 | 26 | 0.15 | 0.17 |  |
| ISIS 544145 | 1146 | 1081 | 2.5 | 29 | 0.14 | 0.24 | 16 |
| ISIS 544199 | 244 | 213 | 2.6 | 25 | 0.13 | 0.15 | 20 |
| ISIS 560400 | 211 | 244 | 2.5 | 28 | 0.14 | 0.14 | 35 |
| ISIS 560401 | 212 | 269 | 2.4 | 31 | 0.14 | 0.12 | 36 |
| ISIS 560469 | 165 | 160 | 2.4 | 24 | 0.11 | 0.14 | 38 |
| ISIS 567320 | 141 | 146 | 2.7 | 25 | 0.14 | 0.15 | 93 |
| ISIS 567321 | 106 | 122 | 2.5 | 24 | 0.11 | 0.13 | 94 |

Body Weights

Body weights were measured on day 43, and are presented in the Table below. Kidney, liver and spleen weights were measured at the end of the study on day 45. ISIS oligonucleotides that caused any changes in organ weights outside the expected range for antisense oligonucleotides were excluded from further studies.

TABLE 76

Weights (g) of CD1 mice after antisense oligonucleotide treatment

|  | Body | Kidney | Liver | Spleen | SEQ ID NO |
|---|---|---|---|---|---|
| PBS | 39 | 0.6 | 2.1 | 0.1 |  |
| ISIS 544145 | 30 | 0.5 | 1.9 | 0.1 | 16 |
| ISIS 544199 | 42 | 0.6 | 2.9 | 0.3 | 20 |
| ISIS 560400 | 40 | 0.6 | 2.8 | 0.3 | 35 |
| ISIS 560401 | 38 | 0.6 | 2.7 | 0.2 | 36 |
| ISIS 560469 | 40 | 0.6 | 2.7 | 0.2 | 38 |
| ISIS 567320 | 39 | 0.6 | 2.3 | 0.3 | 93 |
| ISIS 567321 | 42 | 0.6 | 2.6 | 0.3 | 94 |

Study 4

Male CD1 mice (four animals per treatment group) were injected intraperitoneally with 50 mg/kg or 100 mg/kg of 5-10-5 MOE gapmers or deoxy, MOE and cEt oligonucleotides given once a week for 6 weeks. One group of 4 male CD1 mice was injected intraperitoneally with PBS given once a week for 6 weeks. Mice were euthanized 48 hours after the last dose, and organs and plasma were harvested for further analysis.

Plasma Chemistry Markers

To evaluate the effect of ISIS oligonucleotides, plasma levels of various liver and kidney function markers were measured on day 46 using an automated clinical chemistry analyzer (Hitachi Olympus AU400e, Melville, N.Y.). The results are presented in the Table below. ISIS oligonucleotides that caused changes in the levels of any of these markers outside the expected range for antisense oligonucleotides were excluded in further studies.

TABLE 77

Plasma chemistry marker levels in CD1 mice plasma on day 45

|  | Chemistry | Dose (mg/kg) | ALT (IU/L) | AST (IU/L) | Albumin (g/dL) | BUN (mg/dL) | Creatinine (mg/dL) | Bilirubin (mg/dL) | SEQ ID NO |
|---|---|---|---|---|---|---|---|---|---|
| PBS |  | — | 28 | 46 | 2.7 | 28 | 0.13 | 0.13 |  |
| ISIS 544156 | 5-10-5 MOE | 100 | 80 | 145 | 2.2 | 26 | 0.12 | 0.10 | 17 |
| ISIS 560574 | 5-10-5 MOE | 100 | 182 | 184 | 2.5 | 25 | 0.14 | 0.15 | 44 |
| ISIS 561010 | Deoxy, MOE and cEt | 50 | 32 | 53 | 2.4 | 31 | 0.15 | 0.12 | 113 |
| ISIS 561011 | Deoxy, MOE and cEt | 50 | 93 | 152 | 1.8 | 27 | 0.15 | 0.08 | 114 |
| ISIS 560580 | 5-10-5 MOE | 100 | 50 | 76 | 2.5 | 25 | 0.12 | 0.13 | 237 |
| ISIS 567115 | 5-10-5 MOE | 100 | 202 | 304 | 2.5 | 19 | 0.14 | 0.12 | 88 |
| ISIS 567233 | 5-10-5 MOE | 100 | 123 | 145 | 2.5 | 24 | 0.12 | 0.12 | 90 |

Body Weights

Body weights were measured on day 44, and are presented in the Table below. Kidney, liver and spleen weights were measured at the end of the study on day 46. ISIS oligonucleotides that caused any changes in organ weights outside the expected range for antisense oligonucleotides were excluded from further studies.

TABLE 78

Weights (g) of CD1 mice after antisense oligonucleotide treatment

|  | Chemistry | Dose (mg/kg) | Body | Kidney | Liver | Spleen | SEQ ID NO |
|---|---|---|---|---|---|---|---|
| PBS |  | — | 38 | 0.6 | 2.1 | 0.2 |  |
| ISIS 544156 | 5-10-5 MOE | 100 | 36 | 0.5 | 2.2 | 0.2 | 17 |
| ISIS 560574 | 5-10-5 MOE | 100 | 40 | 0.6 | 2.6 | 0.4 | 44 |
| ISIS 561010 | Deoxy, MOE and cEt | 50 | 39 | 0.5 | 2.2 | 0.2 | 113 |
| ISIS 561011 | Deoxy, MOE and cEt | 50 | 39 | 0.6 | 2.9 | 0.3 | 114 |
| ISIS 560580 | 5-10-5 MOE | 100 | 39 | 0.5 | 2.4 | 0.2 | 237 |
| ISIS 567115 | 5-10-5 MOE | 100 | 36 | 0.5 | 2.2 | 0.2 | 88 |
| ISIS 567233 | 5-10-5 MOE | 100 | 39 | 0.6 | 2.2 | 0.3 | 90 |

Study 5

Male CD1 mice (four animals per treatment group) were injected intraperitoneally with 50 mg/kg of deoxy, MOE and cEt oligonucleotides given once a week for 6 weeks. One group of 4 male CD1 mice was injected intraperitoneally with PBS given once a week for 6 weeks. Mice were euthanized 48 hours after the last dose, and organs and plasma were harvested for further analysis.

Plasma Chemistry Markers

To evaluate the effect of ISIS oligonucleotides, plasma levels of various liver and kidney function markers were measured on day 43 using an automated clinical chemistry analyzer (Hitachi Olympus AU400e, Melville, N.Y.). The results are presented in the Table below. ISIS oligonucleotides that caused changes in the levels of any of these markers outside the expected range for antisense oligonucleotides were excluded in further studies.

TABLE 79

Plasma chemistry marker levels in CD1 mice plasma on day 43

|  | ALT (IU/L) | AST (IU/L) | Albumin (g/dL) | BUN (mg/dL) | Creatinine (mg/dL) | Bilirubin (mg/dL) | SEQ ID NO |
|---|---|---|---|---|---|---|---|
| PBS | 35 | 166 | 2.6 | 29 | 0.12 | 0.32 |  |
| ISIS 559277 | 45 | 77 | 2.5 | 29 | 0.13 | 0.16 | 110 |
| ISIS 561022 | 826 | 802 | 2.9 | 29 | 0.13 | 0.99 | 115 |
| ISIS 561025 | 146 | 183 | 2.3 | 28 | 0.14 | 0.13 | 116 |
| ISIS 561026 | 93 | 154 | 2.6 | 26 | 0.11 | 0.16 | 117 |
| ISIS 561079 | 1943 | 1511 | 2.9 | 28 | 0.15 | 0.94 | 160 |
| ISIS 561084 | 153 | 227 | 2.6 | 27 | 0.12 | 0.16 | 161 |
| ISIS 561123 | 49 | 90 | 2.5 | 31 | 0.13 | 0.13 | 163 |
| ISIS 561436 | 29 | 57 | 2.6 | 25 | 0.12 | 0.12 | 170 |

Body Weights

Body weights were measured on day 41, and are presented in the Table below. Kidney, liver and spleen weights were measured at the end of the study on day 43. ISIS oligonucleotides that caused any changes in organ weights outside the expected range for antisense oligonucleotides were excluded from further studies.

TABLE 80

Weights (g) of CD1 mice after antisense oligonucleotide treatment

|  | Body | Kidney | Liver | Spleen | SEQ ID NO |
|---|---|---|---|---|---|
| PBS | 37 | 0.5 | 2.0 | 0.1 |  |
| ISIS 559277 | 38 | 0.6 | 2.5 | 0.3 | 110 |
| ISIS 561022 | 31 | 0.4 | 3.2 | 0.1 | 115 |
| ISIS 561025 | 37 | 0.5 | 2.6 | 0.2 | 116 |
| ISIS 561026 | 39 | 0.6 | 2.1 | 0.2 | 117 |
| ISIS 561079 | 42 | 0.6 | 4.0 | 0.2 | 160 |
| ISIS 561084 | 37 | 0.6 | 2.4 | 0.2 | 161 |
| ISIS 561123 | 36 | 0.6 | 2.2 | 0.2 | 163 |
| ISIS 561436 | 41 | 0.6 | 2.4 | 0.2 | 170 |

Example 13: Measurement of Viscosity of ISIS Antisense Oligonucleotides Targeting Human ANGPTL3

The viscosity of select antisense oligonucleotides from the studies described above was measured with the aim of screening out antisense oligonucleotides which have a viscosity of more than 40 centipoise (cP). Oligonucleotides having a viscosity greater than 40 cP would have less than optimal viscosity.

ISIS oligonucleotides (32-35 mg) were weighed into a glass vial, 120 μL of water was added and the antisense oligonucleotide was dissolved into solution by heating the vial at 50° C. Part (75 μL) of the pre-heated sample was pipetted to a micro-viscometer (Cambridge). The temperature of the micro-viscometer was set to 25° C. and the viscosity of the sample was measured. Another part (20 μL) of the pre-heated sample was pipetted into 10 mL of water for UV reading at 260 nM at 85° C. (Cary UV instrument). The results are presented in the Table below, where the concentration of each antisense oligonucleotide was 350 mg/ml, and indicate that most of the antisense oligonucleotides solutions are optimal in their viscosity under the criterion stated above.

TABLE 81

Viscosity of ISIS antisense oligonucleotides targeting human ANGPTL3

| ISIS No. | Viscosity (cP) | SEQ ID NO |
|---|---|---|
| 233710 | 14.65 | 233 |
| 337478 | 13.34 | 235 |
| 544145 | 11.97 | 16 |
| 544162 | 8.50 | 18 |
| 544199 | 11.70 | 20 |
| 560306 | 5.67 | 34 |
| 560400 | 9.26 | 35 |
| 560401 | 18.11 | 36 |
| 560402 | 90.67 | 37 |
| 560469 | 12.04 | 38 |
| 560735 | 7.49 | 49 |
| 567320 | 9.05 | 93 |
| 567321 | 9.62 | 94 |
| 567233 | 6.72 | 90 |
| 563580 | 16.83 | 77 |
| 561010 | 26.32 | 113 |
| 561011 | 43.15 | 114 |

Example 14: Tolerability of Antisense Oligonucleotides Targeting Human ANGPTL3 in Sprague-Dawley Rats Sprague-Dawley rats are a multipurpose model used for safety and efficacy evaluations. The rats were treated with ISIS antisense oligonucleotides from the studies described in the Examples above and evaluated for changes in the levels of various plasma chemistry markers.

Study 1

Male Sprague-Dawley rats were maintained on a 12-hour light/dark cycle and fed ad libitum with Purina normal rat chow, diet 5001. Groups of 4 Sprague-Dawley rats each were injected subcutaneously once a week for 6 weeks with PBS or with 100 mg/kg of 5-10-5 MOE gapmers. Forty eight hours after the last dose, rats were euthanized and organs and plasma were harvested for further analysis.

Liver Function

To evaluate the effect of ISIS oligonucleotides on hepatic function, plasma levels of transaminases were measured using an automated clinical chemistry analyzer (Hitachi Olympus AU400e, Melville, N.Y.). Plasma levels of ALT (alanine transaminase) and AST (aspartate transaminase) were measured on day 45 and the results are presented in the Table below expressed in IU/L. Plasma levels of bilirubin were also measured using the same clinical chemistry analyzer and the results are also presented in the Table below expressed in mg/dL. ISIS oligonucleotides that caused changes in the levels of any markers of liver function outside the expected range for antisense oligonucleotides were excluded in further studies.

TABLE 82

Liver function markers in Sprague-Dawley rats

|  | ALT (IU/L) | AST (IU/L) | Bilirubin (mg/dL) | SEQ ID NO |
|---|---|---|---|---|
| PBS | 25 | 65 | 0.11 |  |
| ISIS 544145 | 225 | 407 | 0.30 | 16 |
| ISIS 544199 | 56 | 102 | 0.11 | 20 |
| ISIS 560400 | 55 | 175 | 0.12 | 35 |
| ISIS 560401 | 89 | 206 | 0.13 | 36 |
| ISIS 560469 | 227 | 290 | 0.15 | 38 |
| ISIS 567320 | 55 | 172 | 0.11 | 93 |
| ISIS 567321 | 39 | 109 | 0.10 | 94 |

Kidney Function

To evaluate the effect of ISIS oligonucleotides on kidney function, plasma levels of blood urea nitrogen (BUN) and creatinine were measured using an automated clinical chemistry analyzer (Hitachi Olympus AU400e, Melville, N.Y.). Results are presented in the Table below, expressed in mg/dL. ISIS oligonucleotides that caused changes in the levels of any of the kidney function markers outside the expected range for antisense oligonucleotides were excluded in further studies. Total urine protein and urine creatinine levels were measured, and the ratio of total urine protein to creatinine was evaluated. The results are presented in the Table below.

TABLE 83

Kidney function plasma markers (mg/dL) in Sprague-Dawley rats

|  | BUN | Creatinine | SEQ ID NO |
|---|---|---|---|
| PBS | 16 | 0.27 |  |
| ISIS 544145 | 53 | 0.26 | 16 |
| ISIS 544199 | 24 | 0.34 | 20 |
| ISIS 560400 | 28 | 0.31 | 35 |
| ISIS 560401 | 29 | 0.28 | 36 |
| ISIS 560469 | 23 | 0.32 | 38 |
| ISIS 567320 | 26 | 0.35 | 93 |
| ISIS 567321 | 24 | 0.37 | 94 |

TABLE 84

Kidney function urine markers in Sprague-Dawley rats

|  | Creatinine (mg/dL) | Total protein (mg/dL) | Protein:Creatinine ratio | SEQ ID NO |
|---|---|---|---|---|
| PBS | 59 | 90 | 1.5 |  |
| ISIS 544145 | 27 | 2131 | 84.8 | 16 |
| ISIS 544199 | 24 | 199 | 8.6 | 20 |
| ISIS 560400 | 32 | 176 | 5.4 | 35 |
| ISIS 560401 | 29 | 521 | 17.3 | 36 |
| ISIS 560469 | 43 | 351 | 8.2 | 38 |
| ISIS 567320 | 34 | 177 | 5.2 | 93 |
| ISIS 567321 | 54 | 269 | 5.3 | 94 |

Organ Weights

Body weights were measured on day 42 and presented in the Table below. Liver, spleen and kidney weights were measured at the end of the study on day 45, and are presented in the Table below. ISIS oligonucleotides that caused any changes in organ weights outside the expected range for antisense oligonucleotides were excluded from further studies.

TABLE 85

Body and organ weights (g) of Sprague Dawley rats

|  | Body | Kidney | Liver | Spleen | SEQ ID NO |
|---|---|---|---|---|---|
| PBS | 441 | 3.3 | 11.8 | 0.8 |  |
| ISIS 544145 | 240 | 3.0 | 11.2 | 1.7 | 16 |
| ISIS 544199 | 307 | 2.6 | 10.3 | 2.0 | 20 |
| ISIS 560400 | 294 | 2.8 | 12.3 | 2.0 | 35 |
| ISIS 560401 | 281 | 3.4 | 11.6 | 2.3 | 36 |
| ISIS 560469 | 316 | 3.0 | 11.8 | 2.0 | 38 |
| ISIS 567320 | 312 | 3.1 | 12.4 | 2.5 | 93 |
| ISIS 567321 | 332 | 3.3 | 11.6 | 2.3 | 94 |

Study 2

Male Sprague-Dawley rats were maintained on a 12-hour light/dark cycle and fed ad libitum with Purina normal rat chow, diet 5001. Groups of 4 Sprague-Dawley rats each were injected subcutaneously once a week for 6 weeks with PBS or with 50 mg/kg or 100 mg/kg of 5-10-5 MOE gapmers or deoxy, MOE and cEt oligonucleotides. Forty eight hours after the last dose, rats were euthanized and organs and plasma were harvested for further analysis.

Liver Function

To evaluate the effect of ISIS oligonucleotides on hepatic function, plasma levels of transaminases were measured using an automated clinical chemistry analyzer (Hitachi Olympus AU400e, Melville, N.Y.). Plasma levels of ALT (alanine transaminase) and AST (aspartate transaminase) were measured on day 44 and the results are presented in the Table below expressed in IU/L. Plasma levels of bilirubin were also measured using the same clinical chemistry analyzer and the results are also presented in the Table below expressed in mg/dL. ISIS oligonucleotides that caused changes in the levels of any markers of liver function outside the expected range for antisense oligonucleotides were excluded in further studies.

TABLE 86

Liver function markers in Sprague-Dawley rats

|  | Chemistry | Dose (mg/kg) | ALT (IU/L) | AST (IU/L) | Bilirubin (mg/dL) | SEQ ID NO |
|---|---|---|---|---|---|---|
| PBS | — | — | 22 | 63 | 0.09 |  |
| ISIS 544156 | 5-10-5 MOE | 100 | 153 | 221 | 0.19 | 17 |
| ISIS 560574 | 5-10-5 MOE | 100 | 62 | 128 | 0.24 | 44 |
| ISIS 561010 | Deoxy, MOE and cEt | 50 | 32 | 99 | 0.12 | 113 |
| ISIS 561011 | Deoxy, MOE and cEt | 50 | 56 | 100 | 0.11 | 114 |
| ISIS 563580 | 5-10-5 MOE | 100 | 74 | 89 | 0.09 | 77 |
| ISIS 567233 | 5-10-5 MOE | 100 | 41 | 136 | 0.08 | 90 |

Kidney Function

To evaluate the effect of ISIS oligonucleotides on kidney function, plasma levels of blood urea nitrogen (BUN) and creatinine were measured on day 44 using an automated clinical chemistry analyzer (Hitachi Olympus AU400e, Melville, N.Y.). Results are presented in the Table below, expressed in mg/dL. ISIS oligonucleotides that caused changes in the levels of any of the kidney function markers outside the expected range for antisense oligonucleotides were excluded in further studies. Total urine protein and urine creatinine levels were measured, and the ratio of total urine protein to creatinine was evaluated. The results are presented in the Table below.

TABLE 87

Kidney function plasma markers (mg/dL) in Sprague-Dawley rats

|  | Chemistry | Dose (mg/kg) | BUN | Creatinine | SEQ ID NO |
|---|---|---|---|---|---|
| PBS | — | — | 18 | 0.31 |  |
| ISIS 544156 | 5-10-5 MOE | 100 | 27 | 0.27 | 17 |
| ISIS 560574 | 5-10-5 MOE | 100 | 32 | 0.24 | 44 |
| ISIS 561010 | Deoxy, MOE and cEt | 50 | 24 | 0.31 | 113 |
| ISIS 561011 | Deoxy, MOE and cEt | 50 | 33 | 0.32 | 114 |
| ISIS 563580 | 5-10-5 MOE | 100 | 25 | 0.20 | 77 |
| ISIS 567233 | 5-10-5 MOE | 100 | 37 | 0.23 | 90 |

TABLE 88

Kidney function urine markers in Sprague-Dawley rats

|  | Chemistry | Dose (mg/kg) | Creatinine (mg/dL) | Total protein (mg/dL) | Protein:Creatinine ratio | SEQ ID NO |
|---|---|---|---|---|---|---|
| PBS | — | — | 55 | 66 | 1.2 |  |
| ISIS 544156 | 5-10-5 MOE | 100 | 26 | 166 | 6.2 | 17 |
| ISIS 560574 | 5-10-5 MOE | 100 | 39 | 276 | 6.8 | 44 |
| ISIS 561010 | Deoxy, MOE and cEt | 50 | 54 | 299 | 5.6 | 113 |
| ISIS 561011 | Deoxy, MOE and cEt | 50 | 41 | 525 | 11.7 | 114 |
| ISIS 563580 | 5-10-5 MOE | 100 | 44 | 338 | 8.1 | 77 |
| ISIS 567233 | 5-10-5 MOE | 100 | 46 | 307 | 6.4 | 90 |

Organ Weights

Body weights were measured on day 42 and presented in the Table below. Liver, spleen and kidney weights were measured at the end of the study on day 44, and are presented in the Table below. ISIS oligonucleotides that caused any changes in organ weights outside the expected range for antisense oligonucleotides were excluded from further studies.

TABLE 89

Body and organ weights (g) of Sprague Dawley rats

|  | Chemistry | Dose (mg/kg) | Body | Kidney | Liver | Spleen | SEQ ID NO |
|---|---|---|---|---|---|---|---|
| PBS | — | — | 433 | 3.1 | 10.8 | 0.6 |  |
| ISIS 544156 | 5-10-5 MOE | 100 | 291 | 2.4 | 10.6 | 1.6 | 17 |
| ISIS 560574 | 5-10-5 MOE | 100 | 315 | 3.1 | 10.7 | 2.1 | 44 |
| ISIS 561010 | Deoxy, MOE and cEt | 50 | 386 | 3.0 | 11.9 | 2.1 | 113 |
| ISIS 561011 | Deoxy, MOE and cEt | 50 | 324 | 4.1 | 12.5 | 2.4 | 114 |
| ISIS 563580 | 5-10-5 MOE | 100 | 358 | 3.0 | 12.8 | 1.5 | 77 |
| ISIS 567233 | 5-10-5 MOE | 100 | 286 | 2.9 | 13.0 | 2.9 | 90 |

Study 3

Male Sprague-Dawley rats were maintained on a 12-hour light/dark cycle and fed ad libitum with Purina normal rat chow, diet 5001. Groups of 4 Sprague-Dawley rats each were injected subcutaneously once a week for 6 weeks with PBS or with 50 mg/kg of deoxy, MOE and cEt oligonucleotides. Forty eight hours after the last dose, rats were euthanized and organs and plasma were harvested for further analysis.

Liver Function

To evaluate the effect of ISIS oligonucleotides on hepatic function, plasma levels of transaminases were measured using an automated clinical chemistry analyzer (Hitachi Olympus AU400e, Melville, N.Y.). Plasma levels of ALT (alanine transaminase) and AST (aspartate transaminase) were measured on day 44 and the results are presented in the Table below expressed in IU/L. Plasma levels of bilirubin were also measured using the same clinical chemistry analyzer and the results are also presented in the Table below expressed in mg/dL. ISIS oligonucleotides that caused changes in the levels of any markers of liver function outside the expected range for antisense oligonucleotides were excluded in further studies.

TABLE 90

Liver function markers in Sprague-Dawley rats

|  | ALT (IU/L) | AST (IU/L) | Bilirubin (mg/dL) | SEQ ID NO |
|---|---|---|---|---|
| PBS | 27 | 87 | 0.08 |  |
| ISIS 559277 | 36 | 108 | 0.10 | 110 |
| ISIS 561025 | 150 | 260 | 0.15 | 116 |
| ISIS 561026 | 53 | 105 | 0.08 | 117 |
| ISIS 561079 | 87 | 196 | 0.09 | 160 |
| ISIS 561084 | 62 | 177 | 0.11 | 161 |
| ISIS 561123 | 39 | 94 | 0.07 | 163 |
| ISIS 561436 | 64 | 225 | 0.13 | 170 |

Kidney Function

To evaluate the effect of ISIS oligonucleotides on kidney function, plasma levels of blood urea nitrogen (BUN) and creatinine were measured on day 44 using an automated clinical chemistry analyzer (Hitachi Olympus AU400e, Melville, N.Y.). Results are presented in the Table below, expressed in mg/dL. ISIS oligonucleotides that caused changes in the levels of any of the kidney function markers outside the expected range for antisense oligonucleotides were excluded in further studies. Total urine protein and urine creatinine levels were measured, and the ratio of total urine protein to creatinine was evaluated. The results are presented in the Table below.

TABLE 91

Kidney function plasma markers (mg/dL) in Sprague-Dawley rats

|  | BUN | Creatinine | SEQ ID NO |
|---|---|---|---|
| PBS | 12 | 0.26 |  |
| ISIS 559277 | 16 | 0.30 | 110 |
| ISIS 561025 | 24 | 0.34 | 116 |
| ISIS 561026 | 61 | 0.38 | 117 |
| ISIS 561079 | 87 | 0.67 | 160 |
| ISIS 561084 | 24 | 0.35 | 161 |
| ISIS 561123 | 16 | 0.31 | 163 |
| ISIS 561436 | 39 | 0.37 | 170 |

TABLE 92

Kidney function urine markers in Sprague-Dawley rats

|  | Creatinine (mg/dL) | Total protein (mg/dL) | Protein:Creatinine ratio | SEQ ID NO |
|---|---|---|---|---|
| PBS | 42 | 77 | 1.9 |  |
| ISIS 559277 | 35 | 253 | 7.2 | 110 |

TABLE 92-continued

Kidney function urine markers in Sprague-Dawley rats

|  | Creatinine (mg/dL) | Total protein (mg/dL) | Protein:Creatinine ratio | SEQ ID NO |
|---|---|---|---|---|
| ISIS 561025 | 47 | 583 | 14.3 | 116 |
| ISIS 561026 | 22 | 1993 | 111.4 | 117 |
| ISIS 561079 | 17 | 1313 | 75.5 | 160 |
| ISIS 561084 | 73 | 571 | 7.9 | 161 |
| ISIS 561123 | 33 | 925 | 29.5 | 163 |
| ISIS 561436 | 25 | 789 | 36.6 | 170 |

Organ Weights

Body weights were measured on day 42 and presented in the table below. Liver, spleen and kidney weights were measured at the end of the study on day 44, and are presented in the Table below. ISIS oligonucleotides that caused any changes in organ weights outside the expected range for antisense oligonucleotides were excluded from further studies.

TABLE 93

Body and organ weights (g) of Sprague Dawley rats

|  | Body | Kidney | Liver | Spleen | SEQ ID NO |
|---|---|---|---|---|---|
| PBS | 419 | 3.2 | 10.7 | 0.7 |  |
| ISIS 559277 | 365 | 3.5 | 11.2 | 1.6 | 110 |
| ISIS 561025 | 335 | 3.2 | 12.8 | 2.7 | 116 |
| ISIS 561026 | 334 | 4.9 | 13.9 | 2.3 | 117 |
| ISIS 561079 | 302 | 3.9 | 9.9 | 0.9 | 160 |
| ISIS 561084 | 317 | 3.5 | 12.2 | 1.9 | 161 |
| ISIS 561123 | 367 | 3.3 | 13.5 | 1.5 | 163 |
| ISIS 561436 | 272 | 3.1 | 9.8 | 2.9 | 170 |

Example 15: Effect of ISIS Antisense Oligonucleotides Targeting Human ANGPTL3 in Cynomolgus Monkeys Cynomolgus monkeys were treated with ISIS antisense oligonucleotides selected from studies described in the Examples above. Antisense oligonucleotide efficacy and tolerability, as well as their pharmacokinetic profile in the liver and kidney, were evaluated.

At the time this study was undertaken, the cynomolgus monkey genomic sequence was not available in the National Center for Biotechnology Information (NCBI) database; therefore, cross-reactivity with the cynomolgus monkey gene sequence could not be confirmed. Instead, the sequences of the ISIS antisense oligonucleotides used in the cynomolgus monkeys was compared to a rhesus monkey sequence for homology. It is expected that ISIS oligonucleotides with homology to the rhesus monkey sequence are fully cross-reactive with the cynomolgus monkey sequence as well. The human antisense oligonucleotides tested are cross-reactive with the rhesus genomic sequence (GEN-BANK Accession No. NW_001108682.1 truncated from nucleotides 3049001 to 3062000, designated herein as SEQ ID NO: 3). The greater the complementarity between the human oligonucleotide and the rhesus monkey sequence, the more likely the human oligonucleotide can cross-react with the rhesus monkey sequence. The start and stop sites of each oligonucleotide to SEQ ID NO: 3 is presented in the Table below. "Start site" indicates the 5'-most nucleotide to which the gapmer is targeted in the rhesus monkey gene sequence. 'Mismatches' indicates the number of nucleobases in the human oligonucleotide that are mismatched with the rhesus genomic sequence.

TABLE 94

Antisense oligonucleotides complementary to the rhesus ANGPTL3 genomic sequence (SEQ ID NO: 3)

| ISIS No | Target Start Site | Mismatches | Chemistry | SEQ ID NO |
|---|---|---|---|---|
| 563580 | 9315 | 2 | 5-10-5 MOE | 77 |
| 560400 | 10052 | 1 | 5-10-5 MOE | 35 |
| 567320 | 10232 | 1 | 5-10-5 MOE | 93 |
| 567321 | 10234 | 1 | 5-10-5 MOE | 94 |
| 544199 | 10653 | 0 | 5-10-5 MOE | 20 |
| 567233 | 6834 | 2 | 5-10-5 MOE | 90 |
| 561011 | 3220 | 1 | Deoxy, MOE and (S)-cEt | 114 |
| 559277 | 3265 | 0 | Deoxy, MOE and (S)-cEt | 110 |

Treatment

Prior to the study, the monkeys were kept in quarantine for at least a 30 day period, during which the animals were observed daily for general health. The monkeys were 2-4 years old and weighed between 2 and 4 kg. Nine groups of 5 randomly assigned male cynomolgus monkeys each were injected subcutaneously with ISIS oligonucleotide or PBS at four sites on the back in a clockwise rotation (i.e. left, top, right, and bottom), one site per dose. The monkeys were given loading doses of PBS or 40 mg/kg of ISIS oligonucleotide every two days for the first week (days 1, 3, 5, and 7) and were subsequently dosed once a week for 12 weeks (days 14, 21, 28, 35, 42, 49, 56, 63, 70, 77, and 84) with PBS or 40 mg/kg of ISIS oligonucleotide.

During the study period, the monkeys were observed twice daily for signs of illness or distress. Any animal experiencing more than momentary or slight pain or distress due to the treatment, injury or illness was treated by the veterinary staff with approved analgesics or agents to relieve the pain after consultation with the Study Director. Any animal in poor health or in a possible moribund condition was identified for further monitoring and possible euthanasia. For example, one animal in the ISIS 567321 treatment group was found moribund on day 45 and was terminated. Scheduled euthanasia of the animals was conducted on day 86 (approximately 48 hours after the final dose) by exsanguination after ketamine/xylazine-induced anesthesia and administration of sodium pentobarbital. The protocols described in the Example were approved by the Institutional Animal Care and Use Committee (IACUC).

Hepatic Target Reduction

RNA Analysis

On day 86, RNA was extracted from liver for real-time PCR analysis of measurement of mRNA expression of ANGPTL3. Results are presented as percent change of mRNA, relative to PBS control, normalized with RIBOGREEN®. As shown in the Table below, treatment with ISIS antisense oligonucleotides resulted in significant reduction of ANGPTL3 mRNA in comparison to the PBS control. Analysis of ANGPTL3 mRNA levels revealed that ISIS 544199 and ISIS 559277, which are both fully cross-reactive with the rhesus sequence, significantly reduced expression levels. Other ISIS oligonucleotides, which targeted the monkey sequence with mismatches, were also able to reduce ANGPTL3 mRNA levels.

TABLE 95

Percent inhibition of ANGPTL3 mRNA in the cynomolgus monkey liver relative to the PBS control

| ISIS No | % | SEQ ID NO |
|---|---|---|
| 563580 | 62 | 77 |
| 560400 | 59 | 35 |
| 567320 | 67 | 93 |
| 567321 | 34 | 94 |
| 544199 | 88 | 20 |
| 561011 | 47 | 114 |
| 559277 | 85 | 110 |

Protein Analysis

Approximately 1 mL of blood was collected from all available animals at day 85 and placed in tubes containing the potassium salt of EDTA. The blood samples were placed in ice and centrifuged (3000 rpm for 10 min at 4° C.) to obtain plasma.

Human ANGPTL3 protein levels were quantified using a commercially available ELISA kit (Catalog #DANL30 by R&D Systems, Minneapolis, Minn.) with transgenic plasma samples diluted 1:20,000 using the manufacturer described protocol. The results are presented in the Table below. Analysis of plasman ANGPTL3 revealed that ISIS 563580, 544199 and ISIS 559277 reduced protein levels in a sustained manner. Other ISIS oligonucleotides were also able to reduce ANGPTL3 levels.

TABLE 96

Plasma protein levels (ng/mL) in the cynomolgus monkey

| | Day 1 | Day 3 | Day 16 | Day 30 | Day 44 | Day 58 | Day 72 | Day 86 | SEQ ID NO |
|---|---|---|---|---|---|---|---|---|---|
| PBS | 142 | 113 | 122 | 75 | 147 | 170 | 130 | 158 | |
| ISIS 563580 | 113 | 99 | 102 | 46 | 109 | 93 | 82 | 81 | 77 |
| ISIS 560400 | 92 | 107 | 145 | 63 | 170 | 182 | 157 | 178 | 35 |
| ISIS 567320 | 87 | 72 | 94 | 56 | 176 | 181 | 134 | 166 | 93 |
| ISIS 567321 | 80 | 84 | 98 | 62 | 156 | 116 | 122 | 112 | 94 |
| ISIS 544199 | 114 | 84 | 50 | 34 | 66 | 56 | 81 | 71 | 20 |
| ISIS 567233 | 115 | 111 | 174 | 134 | 162 | 125 | 122 | 109 | 90 |
| ISIS 561011 | 89 | 92 | 111 | 106 | 104 | 100 | 140 | 129 | 114 |
| ISIS 559277 | 86 | 62 | 63 | 54 | 77 | 64 | 68 | 70 | 110 |

Tolerability Studies

Body Weight Measurements

To evaluate the effect of ISIS oligonucleotides on the overall health of the animals, body and weights were measured and are presented in the Table below. The results indicate that effect of treatment with antisense oligonucleotides on body weights was within the expected range for antisense oligonucleotides. Specifically, treatment with ISIS 563580 was well tolerated in terms of the body weights of the monkeys.

TABLE 97

Final body weights (g) in cynomolgus monkey

| | Day 1 | Day 14 | Day 28 | Day 35 | Day 56 | Day 70 | Day 84 | SEQ ID NO |
|---|---|---|---|---|---|---|---|---|
| PBS | 2713 | 2709 | 2721 | 2712 | 2761 | 2754 | 2779 | |
| ISIS 563580 | 2678 | 2669 | 2724 | 2699 | 2797 | 2798 | 2817 | 77 |
| ISIS 560400 | 2713 | 2738 | 2808 | 2767 | 2867 | 2920 | 2976 | 35 |
| ISIS 567320 | 2682 | 2707 | 2741 | 2731 | 2804 | 2830 | 2853 | 93 |
| ISIS 567321 | 2672 | 2745 | 2849 | 2845 | 2995 | 2965 | 3002 | 94 |
| ISIS 544199 | 2760 | 2813 | 2851 | 2897 | 2905 | 2888 | 2871 | 20 |

TABLE 97-continued

Final body weights (g) in cynomolgus monkey

|  | Day 1 | Day 14 | Day 28 | Day 35 | Day 56 | Day 70 | Day 84 | SEQ ID NO |
|---|---|---|---|---|---|---|---|---|
| ISIS 567233 | 2657 | 2668 | 2650 | 2677 | 2907 | 2963 | 2903 | 90 |
| ISIS 561011 | 2753 | 2797 | 2801 | 2811 | 2921 | 2967 | 2941 | 114 |
| ISIS 559277 | 2681 | 2688 | 2701 | 2755 | 2826 | 2831 | 2965 | 110 |

Liver Function

To evaluate the effect of ISIS oligonucleotides on hepatic function, blood samples were collected from all the study groups. The blood samples were collected from the cephalic, saphenous, or femoral veins, 48 hours post-dosing. The monkeys were fasted overnight prior to blood collection. Blood was collected in tubes without anticoagulant for serum separation. The tubes were kept at room temperature for a minimum of 90 minutes and then centrifuged (approximately 3,000 rpm for 10 min) to obtain serum. Levels of various liver function markers were measured using a Toshiba 200FR NEO chemistry analyzer (Toshiba Co., Japan). Plasma levels of ALT and AST were measured and the results are presented in the Table below, expressed in IU/L. Bilirubin, a liver function marker, was similarly measured and is presented in the Table below expressed in mg/dL. The results indicate that most of the antisense oligonucleotides had no effect on liver function outside the expected range for antisense oligonucleotides. Specifically, treatment with ISIS 563580 was well tolerated in terms of the liver function in monkeys.

TABLE 98

ALT levels (IU/L) in cynomolgus monkey plasma

|  | Day 1 | Day 30 | Day 58 | Day 86 | SEQ ID NO |
|---|---|---|---|---|---|
| PBS | 47 | 35 | 32 | 46 |  |
| ISIS 563580 | 56 | 55 | 55 | 83 | 77 |
| ISIS 560400 | 50 | 35 | 47 | 68 | 35 |
| ISIS 567320 | 72 | 44 | 51 | 106 | 93 |
| ISIS 567321 | 53 | 39 | 44 | 75 | 94 |
| ISIS 544199 | 58 | 49 | 51 | 51 | 20 |
| ISIS 567233 | 42 | 38 | 47 | 64 | 90 |
| ISIS 561011 | 48 | 35 | 34 | 43 | 114 |
| ISIS 559277 | 49 | 45 | 53 | 60 | 110 |

TABLE 99

AST levels (IU/L) in cynomolgus monkey plasma

|  | Day 1 | Day 30 | Day 58 | Day 86 | SEQ ID NO |
|---|---|---|---|---|---|
| PBS | 76 | 42 | 39 | 60 |  |
| ISIS 563580 | 75 | 56 | 42 | 81 | 77 |
| ISIS 560400 | 85 | 63 | 59 | 99 | 35 |
| ISIS 567320 | 104 | 64 | 55 | 153 | 93 |
| ISIS 567321 | 83 | 47 | 45 | 66 | 94 |
| ISIS 544199 | 68 | 68 | 70 | 91 | 20 |
| ISIS 567233 | 46 | 80 | 66 | 86 | 90 |
| ISIS 561011 | 48 | 39 | 41 | 51 | 114 |
| ISIS 559277 | 50 | 56 | 55 | 77 | 110 |

TABLE 100

Bilirubin levels (mg/dL) in cynomolgus monkey plasma

|  | Day 1 | Day 30 | Day 58 | Day 86 | SEQ ID NO |
|---|---|---|---|---|---|
| PBS | 0.31 | 0.24 | 0.20 | 0.19 |  |
| ISIS 563580 | 0.34 | 0.23 | 0.17 | 0.18 | 77 |
| ISIS 560400 | 0.29 | 0.19 | 0.14 | 0.13 | 35 |
| ISIS 567320 | 0.38 | 0.24 | 0.16 | 0.19 | 93 |
| ISIS 567321 | 0.35 | 0.20 | 0.16 | 0.17 | 94 |
| ISIS 544199 | 0.23 | 0.16 | 0.17 | 0.15 | 20 |
| ISIS 567233 | 0.26 | 0.17 | 0.15 | 0.12 | 90 |
| ISIS 561011 | 0.20 | 0.13 | 0.16 | 0.13 | 114 |
| ISIS 559277 | 0.22 | 0.15 | 0.16 | 0.15 | 110 |

Kidney Function

To evaluate the effect of ISIS oligonucleotides on kidney function, blood samples were collected from all the study groups. The blood samples were collected from the cephalic, saphenous, or femoral veins, 48 hours post-dosing. The monkeys were fasted overnight prior to blood collection. Blood was collected in tubes without anticoagulant for serum separation. The tubes were kept at room temperature for a minimum of 90 minutes and then centrifuged (approximately 3,000 rpm for 10 min) to obtain serum. Levels of BUN and creatinine were measured using a Toshiba 200FR NEO chemistry analyzer (Toshiba Co., Japan). Results are presented in the Table below, expressed in mg/dL.

The plasma chemistry data indicate that most of the ISIS oligonucleotides did not have any effect on the kidney function outside the expected range for antisense oligonucleotides. Specifically, treatment with ISIS 563580 was well tolerated in terms of the kidney function of the monkeys.

TABLE 101

Plasma BUN levels (mg/dL) in cynomolgus monkeys

|  | Day 1 | Day 30 | Day 58 | Day 86 | SEQ ID NO |
|---|---|---|---|---|---|
| PBS | 28 | 28 | 27 | 29 |  |
| ISIS 563580 | 27 | 27 | 25 | 27 | 77 |
| ISIS 560400 | 25 | 24 | 21 | 27 | 35 |
| ISIS 567320 | 27 | 28 | 26 | 32 | 93 |
| ISIS 567321 | 25 | 24 | 23 | 24 | 94 |
| ISIS 544199 | 23 | 25 | 24 | 23 | 20 |
| ISIS 567233 | 23 | 32 | 30 | 29 | 90 |
| ISIS 561011 | 25 | 24 | 23 | 24 | 114 |
| ISIS 559277 | 26 | 28 | 24 | 26 | 110 |

TABLE 102

Plasma creatinine levels (mg/dL) in cynomolgus monkeys

|  | Day 1 | Day 30 | Day 58 | Day 86 | SEQ ID NO |
|---|---|---|---|---|---|
| PBS | 0.96 | 0.95 | 0.89 | 0.88 |  |
| ISIS 563580 | 0.97 | 1.04 | 0.88 | 0.85 | 77 |
| ISIS 560400 | 0.99 | 1.00 | 0.93 | 0.91 | 35 |
| ISIS 567320 | 0.95 | 0.94 | 0.89 | 0.87 | 93 |
| ISIS 567321 | 0.97 | 0.94 | 0.89 | 0.87 | 94 |
| ISIS 544199 | 0.86 | 0.87 | 0.88 | 0.87 | 20 |
| ISIS 567233 | 0.89 | 1.08 | 1.06 | 1.00 | 90 |
| ISIS 561011 | 0.93 | 0.93 | 0.91 | 0.90 | 114 |
| ISIS 559277 | 0.86 | 0.91 | 0.87 | 0.91 | 110 |

Hematology

To evaluate any effect of ISIS oligonucleotides in cynomolgus monkeys on hematologic parameters, blood samples of approximately 0.5 mL of blood was collected from each of the available study animals in tubes containing $K_2$-EDTA. Samples were analyzed for red blood cell (RBC) count, white blood cells (WBC) count, individual white blood cell counts, such as that of monocytes, neutrophils, lymphocytes, as well as for platelet count, hemoglobin content and hematocrit, using an ADVIA120 hematology analyzer (Bayer, USA). The data is presented in the Tables below.

The data indicate the oligonucleotides did not cause any changes in hematologic parameters outside the expected range for antisense oligonucleotides at this dose. Specifically, treatment with ISIS 563580 was well tolerated in terms of the hematologic parameters of the monkeys.

TABLE 103

Blood cell counts in cynomolgus monkeys

|  | RBC ($\times 10^6$/μL) | Platelets ($\times 10^3$/μL) | WBC ($\times 10^3$/μL) | Neutrophils (% WBC) | Lymphocytes (% total) | Monocytes (% total) | SEQ ID NO |
|---|---|---|---|---|---|---|---|
| PBS | 5.6 | 462 | 12.2 | 58 | 39 | 2 |  |
| ISIS 563580 | 5.5 | 394 | 10.7 | 52 | 44 | 2 | 77 |
| ISIS 560400 | 5.7 | 269 | 10.2 | 44 | 50 | 3 | 35 |
| ISIS 567320 | 5.1 | 329 | 9.1 | 51 | 44 | 3 | 93 |
| ISIS 567321 | 5.3 | 363 | 8.9 | 60 | 36 | 2 | 94 |
| ISIS 544199 | 5.6 | 316 | 9.7 | 34 | 61 | 3 | 20 |
| ISIS 567233 | 5.0 | 298 | 12.1 | 40 | 53 | 4 | 90 |
| ISIS 561011 | 5.5 | 356 | 10.2 | 33 | 62 | 3 | 114 |
| ISIS 559277 | 5.1 | 343 | 8.3 | 45 | 49 | 3 | 110 |

TABLE 104

Hematologic parameters in cynomolgus monkeys

|  | Hemoglobin (g/dL) | HCT (%) | SEQ ID NO |
|---|---|---|---|
| PBS | 13 | 43 |  |
| ISIS 563580 | 12 | 40 | 77 |
| ISIS 560400 | 12 | 41 | 35 |
| ISIS 567320 | 11 | 38 | 93 |
| ISIS 567321 | 12 | 41 | 94 |
| ISIS 544199 | 13 | 44 | 20 |
| ISIS 567233 | 11 | 38 | 90 |
| ISIS 561011 | 13 | 42 | 114 |
| ISIS 559277 | 12 | 40 | 110 |

Effect on Pro-Inflammatory Molecules

To evaluate any inflammatory effect of ISIS oligonucleotides in cynomolgus monkeys, blood samples were taken for analysis of C-reactive protein and C3 levels on day 84 pre-dose. Approximately 1.5 mL of blood was collected from each animal and put into tubes without anticoagulant for serum separation. The tubes were kept at room temperature for a minimum of 90 min and then centrifuged at 3,000 rpm for 10 min at room temperature to obtain serum. C-reactive protein (CRP) and complement C3, which serve as markers of inflammation, were measured using a Toshiba 200FR NEO chemistry analyzer (Toshiba Co., Japan). The results indicate that treatment with ISIS 563580 was tolerable in monkeys.

TABLE 105

C-reactive protein levels (mg/L) in cynomolgus monkey plasma

|  | Day 1 | Day 30 | Day 58 | Day 86 | SEQ ID NO |
|---|---|---|---|---|---|
| PBS | 3.1 | 5.5 | 2.7 | 4.1 |  |
| ISIS 563580 | 2.4 | 2.4 | 4.5 | 3.9 | 77 |
| ISIS 560400 | 3.4 | 7.5 | 9.2 | 14.4 | 35 |
| ISIS 567320 | 2.5 | 1.7 | 2.5 | 4.3 | 93 |
| ISIS 567321 | 3.7 | 3.1 | 5.5 | 7.0 | 94 |
| ISIS 544199 | 1.2 | 1.5 | 8.8 | 8.1 | 20 |
| ISIS 567233 | 1.9 | 12.0 | 6.8 | 6.6 | 90 |
| ISIS 561011 | 1.7 | 1.2 | 2.1 | 3.7 | 114 |
| ISIS 559277 | 1.8 | 2.1 | 10.9 | 5.2 | 110 |

TABLE 106

C3 levels (mg/dL) in cynomolgus monkey plasma

|  | Pre-dose | Day 84 | SEQ ID NO |
|---|---|---|---|
| PBS | 122 | 117 |  |
| ISIS 563580 | 116 | 84 | 77 |
| ISIS 560400 | 120 | 105 | 35 |
| ISIS 567320 | 114 | 100 | 93 |
| ISIS 567321 | 106 | 93 | 94 |
| ISIS 544199 | 113 | 66 | 20 |
| ISIS 567233 | 113 | 63 | 90 |
| ISIS 561011 | 115 | 79 | 114 |
| ISIS 559277 | 119 | 87 | 110 |

Measurement of Oligonucleotide Concentration

The concentration of the full-length oligonucleotide was measured. The method used is a modification of previously published methods (Leeds et al., 1996; Geary et al., 1999) which consist of a phenol-chloroform (liquid-liquid) extraction followed by a solid phase extraction. An internal standard (ISIS 355868, a 27-mer 2'-O-methoxyethyl modified phosphorothioate oligonucleotide, GCGTTTGCTCTTCTTCTTGCGTTTTT, designated herein as SEQ ID NO: 13) was added prior to extraction. Tissue sample concentrations were calculated using calibration curves, with a lower limit of quantitation (LLOQ) of approximately 1.14 µg/g. The results are presented in the Table below, expressed as µg/g liver or kidney tissue. The ratio of full-length oligonucleotide concentrations in the kidney versus the liver was calculated. The ratio of full-length oligonucleotide concentrations in the kidney versus the liver after treatment with ISIS 563580 was found to be most optimal compared to other compounds assessed.

TABLE 107

Oligonucleotide full length concentration

| ISIS No | Kidney | Liver | Kidney/Liver ratio | SEQ ID NO |
|---|---|---|---|---|
| 563580 | 1822 | 1039 | 1.8 | 77 |
| 560400 | 3807 | 1375 | 2.8 | 35 |
| 567320 | 2547 | 569 | 4.5 | 93 |
| 567321 | 2113 | 463 | 4.6 | 94 |
| 544199 | 1547 | 561 | 2.8 | 20 |
| 561011 | 2027 | 477 | 4.3 | 114 |
| 559277 | 2201 | 508 | 4.3 | 110 |

Example 16: ISIS 563580 Clinical Trial

To assess the effect of Study Drug ISIS 563580 a Phase 1, blinded, randomized, placebo-controlled, dose-escalation study was performed on healthy volunteers with a normal lipid profile. The study evaluated the safety, tolerability, pharmacokinetics, effect on plasma levels of ANGPLT3 and the lipoprotein profile of the study subjects after single and multiple doses of the Study Drug ISIS 563580.

The study population was healthy males or females aged 18-65 inclusive. Exclusion criteria included clinically significant abnormalities in the medical history and in the screening laboratory values of any of the subjects. Subjects were randomized 3:1 to receive ISIS 563580 or placebo within each single-dose and multiple-dose cohort. Subjects were administered the study drug or placebo subcutaneously (SC).

Blood and urine samples were collected regularly throughout the study for safety, pharmacokinetic, and pharmacodynamics analyses. The safety and tolerability of ISIS 563580 was assessed by determining the incidence, severity, and dose-relationship of adverse events, vital signs, and clinical laboratory parameters. Safety results in subjects dosed with ISIS 563580 were compared with those in subjects dosed with placebo.

The most frequent adverse events were mild, local reactions at the injection site. Treatment with ISIS 563580 was generally well-tolerated and demonstrated an acceptable safety profile.

Study Drug and Treatment for Single Dose Study

A solution of the Study Drug ISIS 563580 (200 mg/mL, 1.0 mL) contained in 2-mL stoppered glass vials was provided. Vials were for single-use only. ISIS 563580 solution and placebo are prepared by a pharmacist (or qualified delegate). A trained professional administered a single dose of the Study Drug in the abdomen, thigh, or outer area of the upper arm on each dosing day. A total of 16 subjects were enrolled in this study. The study design is presented in the Table below:

TABLE 108

Study design for single dose study with ISIS 563580

| Cohort | Dose (mg) |
|---|---|
| A | 50 |
| B | 100 |
| C | 200 |
| D | 400 |

Subcutaneous injection volumes were 0.25, 0.5, 1.0, and 2.0 mL for cohorts A, B, C, and D, respectively, with the 2.0 mL volume given as 2 non-contiguous 1.0 mL injections. For cohort A, a period of at least 24 hours was required between administering the Study Drug to the first 2 subjects and the remaining 2 subjects in the cohort. Dose escalation proceeded when the subjects in the preceding single-dose cohort had completed dosing and Day 4 safety evaluations demonstrated an acceptable safety profile.

The length of each subject's participation was approximately 8 weeks, including a 4-week screening period, a single dose, and a 4-week post-treatment evaluation period. Subjects had follow-up visits at the Study Center on Days 2, 4, 8, 15, and a telephone contact on Day 30. The effect of the study drug is being assessed.

Study Drug and Treatment for Multiple Dose Study

A solution of the Study Drug ISIS 563580 (200 mg/mL, 1.0 mL) contained in stoppered glass vials was provided. Vials were for single-use only. ISIS 563580 solution and placebo are prepared by a pharmacist (or qualified delegate). A trained professional administered the Study Drug in the abdomen, thigh, or outer area of the upper arm on each dosing day. A total of 32 subjects were enrolled in this study. The study design is presented in the Table below

TABLE 109

Study design for multiple dose study with ISIS 563580

| Cohort | Dose amount | Amount of drug per dose | Total Dose (mg) |
|---|---|---|---|
| AA | 8 | 100 | 800 |
| BB | 8 | 200 | 1600 |
| CC | 8 | 300 | 2400 |
| DD | 8 | 400 | 3200 |

Subcutaneous injection volumes were 0.5, 1.0, 1.5, and 2.0 mL for cohorts AA, BB, CC, and DD, respectively, with the 2.0 mL volume given as 2 non-contiguous 1.0 mL injections. Dosing of the first cohort (Cohort AA) began after at least 4 subjects in the single-dose cohort (Cohort D) had completed dosing and Day 4 safety evaluations demonstrated an acceptable safety profile. Subjects received 3 subcutaneous doses of the Study Drug during week 1 on alternative days (Days 1, 3, and 5) followed by once-weekly SC administrations during the next 5 weeks (Days 8, 15, 22, 29, and 36) for a total of 8 doses.

The length of each subject's participation was approximately 5.5 months, including a 4-week screening period, a 6-week treatment period, and a 13-week post-treatment evaluation period. Subjects had follow-up visits at the Study Center on Days 37, 43, 50, 64, 78, 92, 106, and 127. The results of the lipid profiles of the subjects on Day 36 are presented in the Table below. The asterisks indicate statistically significant changes ($p<0.05$).

Treatment with ISIS 563580 generally produced dose-dependent reductions in plasma ANGPTL3, triglycerides, LDL-cholesterol, non-HDL cholesterol, VLDL-cholesterol, total cholesterol, ApoB and ApoC-III at day 36. In general, the magnitude of the reductions was associated with baseline lipid levels, with larger reductions observed in subjects with higher baselines.

TABLE 110

Mean % change compared the baseline at Day 36

| Parameter | Placebo (N = 8) | 100 mg ISIS 563580 (N = 6) | 200 mg ISIS 563580 (N = 6) | 300 mg ISIS 563580 (N = 6) | 400 mg ISIS 563580 (N = 6) |
|---|---|---|---|---|---|
| ANGPTL3 | −8.1 | −17.3 | −51.6** | −62.4** | −81.9** |
| LDL-cholesterol | −0.9 | −5.3 | −12.8 | −20.4* | −22.4** |
| Triglycerides | −15.3 | −23.8 | −21.0 | −49.1** | −44.3** |
| Non-HDL-cholesterol | −3.2 | −9.0 | −15.4* | −25.4** | −25.6** |
| VLDL-cholesterol | −15.2 | −25.1 | −21.5 | −50.0** | −43.5* |
| Total cholesterol | 0.4 | −2.1 | −12.4* | −22.4** | −28.1** |
| ApoB | −5.1 | −8.2 | −8.8 | −27.1* | −12.5 |
| ApoC-III | 20.6 | 8.2 | −20.3 | −51.3** | −65.0** |

*P < 0.05;
**p < 0.01

SEQUENCE LISTING (4877 sequences)

SEQ ID NO: 1 - DNA, 2126 bp, Homo sapiens
  CDS (52)..(1434)
ttccagaagaaaacagttccacgttgcttgaaattgaaaatcaagataaaaatgttcacaattaagctccttctttttattgttcctctagttatttcctccagaattgatcaagacaattcatcatttgattctctatctccagagccaaaatcaagatttgctatgttagacgatgtaaaaattttagccaatggcctccttcagttgggacatggtcttaaagactttgtccataagacgaagggccaaattaatgacatatttcaaaaactcaacatatttgatcagtctttttatgatctatcgctgcaaaccagtgaaatcaaagaagaagaaaaggaactgagaagaactacatataaactacaagtcaaaaatgaagaggtaaagaatatgtcacttgaactcaactcaaaacttgaaagcctcctagaagaaaaaattctacttcaacaaaaagtgaaatatttagaagagcaactaactaacttaattcaaaatcaacctgaaactccagaacacccagaagtaacttcacttaaaacttttgtagaaaaacaagataatagcatcaaagaccttctccagaccgtggaagaccaatataaacaattaaaccaacagcatagtcaaataaaagaaatagaaaatcagctcagaaggactagtattcaagaacccacagaaatttctctatcttccaagccaagagcaccaagaactactccctttcttcagttgaatgaaataagaaatgtaaaacatgatggcattcctgctgaatgtaccaccatttataacagaggtgaacatacaagtggcatgtatgccatcagacccagcaactctcaagtttttcatgtctactgtgatgttatatcaggtagtccatggacattaattcaacatcgaatagatggatcacaaaacttcaatgaaacgtgggagaactacaaatatggttttgggaggcttgatggagaattttggttgggcctagagaagatatactccatagtgaagcaatctaattatgttttacgaattgagttggaagactggaaagacaacaaacattatattgaatattctttttacttgggaaatcacgaaaccaactatacgctacatctagttgcgattactggcaatgtccccaatgcaatcccggaaaacaaagatttggtgttttctacttgggatcacaaagcaaaaggacacttcaactgtccagagggttattcaggaggctggtggtggcatgatgagtgtggagaaaacaacctaaatggtaaatataacaaaccaagagcaaaatctaagccagagaggagaagaggattatcttggaagtctcaaaatggaaggttatactctataaaatcaaccaaaatgttgatccatccaacagattcagaaagctttgaatgaactgaggcaaatttaaaaggcaataatttaaacattaacctcattccaagttaatgtggtctaataatctggtattaaatccttaagagaaagcttgagaaatagattttttttatcttaaagtcactgtctatttaagattaaacatacaatcacataaccttaaagaataccgtttacatttctcaatcaaaattcttataatactatttgttttaaattttgtgatgtgggaatcaattttagatggtcacaatctagattataatcaataggtgaacttattaaataacttttctaaataaaaaatttagagacttttattttaaaaggcatcatatgagctaatatcacaactttcccagtttaaaaaactagtactcttgttaaaactctaaacttgactaaatacagaggactggtaattgtacagttcttaaatgttgtagtattaatttcaaaactaaaaatcgtcagcacagagtatgtgtaaaaatctgtaatacaaatttttaaactgatgcttcattttgctacaaaataatttggagtaaatgtttgatatgatttatttatgaaacctaatgaagcagaattaaatactgtattaaaataagttcgctgtctttaaacaaatggagatgactactaagtcacattgactttaacatgaggtatcactataccttatt

SEQ ID NO: 2 - DNA, 14000 bp, Homo sapiens
caagactacgtgaccattacctctactctgtcagtgttatttgtgagaaattgcacaaattttgcaaaaagtgttagtatcctactacagtaggatataatatagaaggaaataatttcataaagcctgtctttggtactagtgctcagttactttcattaactaaaaaaggggctactcttcaaattcccttctctaaaaagaatgtactatatcaaaagggggtaaacactactacgtatacattctgcacttagaaatccctatatgttgattttatcattctcttattcaataaatattgtttctacaatgtgtaaggcattactgtactaaagcattataaggaatataagttaaaaacacatacaaatcttgccaatcaacagcttatagtgtaataggggagagaagctggcccatctatattctccctcaactagcaagtggatgaaatatcagggtcaatagttataagccacaaaagctgacagcttaattaagagaagttttgaaatatgtatttcatgaccaataattacaactgtaacttttctatttaaagaaggagaaaatttgaatttcttctctagctcaacatacacttctataattccattacatgaaccagagtaaagggtaagatggaaatgaagaatattttcttacccttttgtggttctatattggacacttaaaaatcatacacaacctaatcaaaagatgtaattctttaaaaaggtacgagaccaaaattcagaaaatctagactataacaaaatttctcaatttacattatcttaatatgcaattaattttcaccagtaaaatactatagtatgggtacaaatgcattgattagttctaattacaaaaatggctaatatataatactgtgtagtgtttatgatacatcagataatgttctaagtgctctgaaaatataaacttttaatcttttatacgaccctataaaataggtgttattctcactggagagatgagaaaacaggggttcagagatgtgaagtaatttgaccaaaggtcacaaagctgaagaatatgaaatccgggattctgattcaggcagtcttattccagaatcatgctcttaaccactatggaatactgcctctactgtaactattatacccaaaacccttaatcctaagtcatcaaaaggaagagcctctattttacacaatgaagaggcatttctaagaatagaaatttagggacgagcacagtggcttactcctttaatatcagcactttgagaggctgatatgggaggttcacttgaagtcaggagttcaaggtcagcttgggcaacatagtgaaacacagtctctacaaaatatttaaaaattagctgggtgtggtggcatgcatctatagtctcagctacttgggagacagagggaggaggcttgctcgagcccaggagttcgtggctatagtgagctatgatcatgccactgcactccagcctggacaacagagcaagaccctgtctctaaaaaagaaaagaaatttggaaatggtttattttgtattaacaatttataatttacactgaaatttattatgataaaacttttccctgtgttaaaaagctattaactttatgaaaaatttcttttaggtaaggttgattatatatacccacacacatacacaggttaaaagttagtttcatgtgacataataactagcattttgagcactacctgtttgcccagcactgttctaagtgctctacatgtattattgttaaattatcataacactatgaattatgtactataattaccccagctttacagatgaggagactaatccatggggaggttaagtaacttgtccaaggccagacagctagagccggcttttggacccacaccacagtctgactccagcacccatattcttaacaatttcaccatattaatatgtcaagattaagcagttttaaaggatgctattttctcacaaatttcttaatatgaacactcaataagaataatcactaatataagcatttagtatttttttaacactaagttggaagcatagtggaacatttatttttagaaatattattaattggctgggctcacgcttgtaatcggctgggctcatgcctgtaaattttgggaggccaaggtaaaagaattgcttgagcccagtatttccagaccagcatgggcaatacattaagacatcatctttaaaaaaaaaatgttattaatctcctctttttgttaaatgtatattatcaaaattgttactaagctaacaaacttcagaaaaacttatgatgggcaagctgcttgtgacattgaaggtatttaagattcaattctagtttggtcctagatgaccacatatccattgttccttcaacgagcacatggtaaagagcctagaacacagagacacagaacacagtggagaaaagggagtgaaatgtctttaatgacacttactatatatgggattttgtgacaatatacaaggatggttaagacatataaggtgatgcaaaaaaacatattaacaattatagtgacaaaaaatgaggagcatataattatacattgatttatacagagtaccagaggaacacagcattgagagccgtaacaccacctgagggagtggagaaaggcttcagagagaaagtgttttttggaatggatcactgtttccaaaagaactaaagtacagtttgagaaatgcatacttaattcattacttttttcccctcaactttaataataaatttacccaacaaaaaagtttatttttgacttgtaaatctcttaaaatcataaaaaagtaaaattagcttttaaaaacaggtagtcaccatagcattgaatgtgtagtttataatacagcaaagttaaatacaatttcaaattacctattaagttagttgctcatttctttgatttcatttagcattgatctaactcaatgtggaagaaggttacattcgtgcaagttaacacggcttaatgattaactatgttcacctaccaaccttaccttttctgggcaaatattggtatatatagagttaagaagtctaggtctgcttccagaagaaaacagttccacgttgcttgaaattgaaaatcaagataaaaatgttcacaattaagctccttctttttattgttcctctagttatttcctccagaattgatcaagacaattcatcatttgattctctatctccagagccaaaatcaagatttgctatgttagacgatgtaaaaattttagccaatggcctccttcagttgggacatggtcttaaagactttgtccataagacgaagggccaaattaatgacatatttcaaaaactcaacatatttgatcagtctttttatgatctatcgctgcaaaccagtgaaatcaaagaagaagaaaaggaactgagaagaactacatataaactacaagtcaaaaatgaagaggtaaagaatatgtcacttgaactcaactcaaaacttgaaagcctcctagaagaaaaaattctacttcaacaaaaagtgaaatatttagaagagcaactaactaacttaattcaaaatcaacctgaaactccagaacacccagaagtaacttcacttaaagtaagtagaaaataaagagggttcatgtttatgttttcaatgtggatcttttaaaaaaaatatttctaaggcatgccatttgaaatactttgttgcattgttgaaatacttttttttccaagaaaaataatctccagaaaataaaatttcctattataatttcaagttagttttttgtttccctaatgttatatatgaaaacactgaaaatttgcattttatatgaaaattacaaatcggttaaattatacaatctagaacactatgtcattacactattgtaaattactgaaggtaagtaaaaagttaaaaaaaatttaaaactattctccagtgtttaaaacagattaaataatacagtaaatggaaaagatttattcatatgaaaatatgctgggctttttcttttaattgaagttcagaaaatcaaattttagagatagtacaatttaaataaaatgttaaggacaaaaatatgtgctatttgaaagaagcatacaaggggaaggaattgccaatattcatttttcaaatccattattagtttaaaaatttagattatgatagtgttacaggaaattaatagaaaagaaagaggaaagcaacttataaccaacctactctctatatccagacttttgtagaaaaacaagataatagcatcaaagaccttctccagaccgtggaagaccaatataaacaattaaaccaacagcatagtcaaataaaagaaatagaaaatcaggtaagtcagtattttaatggtatgtcccatctttcacacaggtctgtaaaaacactgaatcctaaaattatttacaagctttaactggatcatgagtaaaattatcacatcagcataactgttaaaattgcaggctctgaagctaataaactacctgcatttaaaccatggctctaaaactttgtgtgaccttgaataaattacttcacccctttatctctcagtttcctcacatatactacaaagataataacagaacttataggattattgtaagaaaaaaaattaattcatagcagccaatgtcatcttactaaaattcaaattagatcatgtttctctttgctcaaaaccacacaatagctttccatttcactcatattggctctttagaccaagattacccaacccttcgtcatctcactgacttcacctcctctactctagttattctgaccgctttaccagtattcaaacacatcaaacatactgccacctcaaagcctttgcccttgttgtttcctctaactggaacgctcttctgccctggtatctacgtggcccactctctgatttcccttagggtcgttatcaaacaaaaaattcccaatgaagacttacaaggtcacttaaccaaaaatcacaaccgcctggtcccatccctgaaaacttctacttccttagctacttttctcctgcacactcacctttatttaacataacataaattttagttatttatctcttctattcctgcactaaaatgtaagctctgtgaatacagggattttttccattatcttcatattttccattatttgtatatactccagaatatagaatactgtatggcacacagtaggcatttctgttgaattaataaatgtaatgtcatattcacacagaagcgtgtgctatgattattattacttggattactagaaatagtgtgcctcataattaaaggtcaacattcaacaatgtaattaatctacaatgtaaacatctggtgaagtgacagagggaagcacttgtttagaaaaaagctatgtcagaatccatgtattctaatatgcagtacaatagtttaaaaatattaataatactctcaaacagctattcaagaggattcaaaaaacataatataaactcagagaaactggtaaacaaaatcattttcaagagatataaaacaaatattattaccaatttccactaaacaaacataatgttagtagtgctgctaaaaggttttttatcaactacttttggtttccatactttccttcttatgatgttattattctaaattcttttcaattatatcttttactatgattaaatgaacctgctccccaaagcaaaatgttactatagtaatatacattgtgtctaaaaataaaaatgtgtgaagaaaccaaaacaatgaatttctgagttggaagaagagttagatcatttaactttctcatatttaaattaaaaaaacaaaactctaaaaatttaagtaactttaagatcacatagttacttagtagaaaagagtaatacccagcaagcaaactttacaatagatccttttaaataaggtcctaggaaatatcattcatgccagcatcaaaaaactaacactaataatgcaagatattatatattctgcttttcttactgtcaatgagaaaaactatcattcaataaattgcaaacccaacacacttaaataaaaataaaatgttactgctaaactaacgataaactactgaatatatagaaagtaagcaaacaaacttgccaacctgccaacatctacagatatgtttacaggtcaaaaattatcaaattatcaagaaagcctggttcaaattatgtattatgtctttatcacaggtctgaagatcagtaagacctaaaactgaaaattattaaacttaaaatctgaacagaatatcaaatatattttattcatataaataaaagaatacattacaatattctaagcaaagcagtctctacttttggccttgctctgttttccgaccaatgtctgcttttttgccttgctttatttttttatcttattaaataatgtccctgattaaatattttgagaacaggtaatctgtacaatctgaataacactgtttatctaaatatcaaacaccgttataacattatgaactgaaagacaaactgtacttctgacatccttactcagatttcccctaattgtatattcagtatcattttaaaaaacagatttatattcttttatcagctcagaaggactagtattcaagaacccacagaaatttctctatcttccaagccaagagcaccaagaactactccctttcttcagttgaatgaaataagaaatgtaaaacatgatggtaagacactttggtgggtttccttcttgaagctattattatcaaattccctattcttaggacttgttctagactaaaagatagttaagagatatccatcaaatacaatgtatcaacctaaactggatgctggggttctttttacaccctataaaagacatacctaagacaatcagagaaatacaaatatggacttgattattagataatatagaaggtttattaattttcttagatgtgatcatggtattgcagttttaaaggagaacaatctcctgtttaagagatacatgctgaaatatttacggagttaaaggtcactggactccagactggtgatagaacaagactctgtctctaaaaaataattaattttttaaaagaaaatagtttggtaagatgattcttacattcttaaataacacgccatctaagaaaaatgctttaacataaacattactgaaaaaatgctacatttgccacaacttcataaaatgtcaagtgaaatctcaagctccaaagatattattcctattactaaatctgatgtaataacattttattgattctaggcattcctgctgaatgtaccaccatttataacagaggtgaacatacaagtggcatgtatgccatcagacccagcaactctcaagtttttcatgtctactgtgatgttatatcaggtaaaacctgtctaaggagaatagacagtagttagttcaacttactcattacgtattaggaagattaacctggttatcattgttttatacatatatatatgaaatatatatgagtattcgtataaatataatacttttaccttgtttatgtatttactcaatattctccttttcctctaaaataatctgaagtgactattatcaataagtttactatgccaaaattcattaattgcctttcacttaacttttgggaccataataaataataaaatgtattgccataacattaataaactaccttacaaaaccaccaattaaaatcaaacaaacaaaaaagtgttatttacatctgtcaacataaatctactaaaaatacatgatttcattcattatattcaggtagtccatggacattaattcaacatcgaatagatggatcacaaaacttcaatgaaacgtgggagaactacaaatatggttttgggaggcttgatggtaaggggactacattcaatcattcattcacttgctaatctacaaatatttactgagaacctcttatggaccaggtattaggaaaagtagtaacgaacgagaagcagtctcagccttcatataatttattatcaaacaattacacatttgttagtaaattacacttattacaactgttattatttgaattatatttatcacaattacatgtctgttcttaaatatacttatcacaatttaattccacggcttacaatgatcataactataattattaaagacaattttgattaaatgttatgtcataagtagtaactgttacaaataagctgtgaaaagaaccactcctagcattagtcactctattctctcattaacgttttacatatcaattaattggaagttaaaaggaccaggaaactcagacatacagtatacattttaaaatttcaattatttaaatataatatatagaatgtatggcttataatgaattagttaactcaatgcaaattattctattttgattacaaatagtaaaataagcaagataaaataacagatgtttaaaatccaaaaagcacatacaaaaatccatgaatgatgtctaagtactcacttataaagtagaagacattcattattatatcaaatttttaaatgctcagtactatttgaccatttaaaaattttgtattcaaactaccagtgaaagccctacctagaaggtatactcagtgataagttttgtagctccaaatcttctaatagtgagtgtaaccccaaaataaaaggctgacaggtaagtcgagaatactcacttaattctggtaagaaagcaacccatttgtacttgtatttaccagcaatccttaaaatgaagcttcctactaactcaatagcaataagacaatagtgaatgtttaatgaaaacagtattttataaatactttaataaaaaggattgtgatgaagaacaatctatttatatttgttatttgtttttaattccaataaaaataatttttaaaattacagaaaaaagttattaagaaccatgcttttaaatttaaaatgattttttaaatttattcctgtctttttctacaaagaaagcatacattaagcaaataccaaaggccaggtttacatttgaagaaagtgacattattattactcaagtctctaggaatacttaacacatctcttgactgtatatggatgttaataaatagctgacagtaaagtttatccatataaagacttgcaaatattcctctaccaatgacgagactttaaaatatctataataatgtaacacatttcactggtgaaacatgtcttgtcatatgcattatagaaaggataatcagactttcagttatattaatatttttaacatttttgtgcacatagctatcttcaataaaattgttttaaaaggtattattttaagatacactaaaatgatcaagggattcaagactaaacaactcaattagttgcaccaataaaaaacacttaaaaaaactgtcagtgtccaacctgtacttaataactcacagatttttaaaacttttcttttcaggagaattttggttgggcctagagaagatatactccatagtgaagcaatctaattatgttttacgaattgagttggaagactggaaagacaacaaacattatattgaatattctttttacttgggaaatcacgaaaccaactatacgctacatctagttgcgattactggcaatgtccccaatgcaatcccggaaaacaaagatttggtgttttctacttgggatcacaaagcaaaaggacacttcaactgtccagagggttattcaggtatctttttctgataccaatactttattttcatatcttcaaagtatcttcccacattattagctattatctgcaatgacaacttttaaaaatccgaatcccaaataagcgttttctctctagacgaaaacctcttaactataatgaaagtgttcattctagttcaatcaggtattttacctctaatcttcctcagattttctattttttggtagtgtatagattatttatacagattatttaaaattgggacttatacagattatttaaaactgggatacatgcatctaaaacactgtaatatttataagaaaggaagataaacttacggggaaatacagtaacagtaactacatacgagtctgtacccattaaattgcatatctatctcctttaggaggctggtggtggcatgatgagtgtggagaaaacaacctaaatggtaaatataacaaaccaagagcaaaatctaagccagagaggagaagaggattatcttggaagtctcaaaatggaaggttatactctataaaatcaaccaaaatgttgatccatccaacagattcagaaagctttgaatgaactgaggcaaatttaaaaggcaataatttaaacattaacctcattccaagttaatgtggtctaataatctggtattaaatccttaagagaaagcttgagaaatagattttttttatcttaaagtcactgtctatttaagattaaacatacaatcacataaccttaaagaataccgtttacatttctcaatcaaaattcttataatactatttgttttaaattttgtgatgtgggaatcaattttagatggtcacaatctagattataatcaataggtgaacttattaaataacttttctaaataaaaaatttagagacttttattttaaaaggcatcatatgagctaatatcacaactttcccagtttaaaaaactagtactcttgttaaaactctaaacttgactaaatacagaggactggtaattgtacagttcttaaatgttgtagtattaatttcaaaactaaaaatcgtcagcacagagtatgtgtaaaaatctgtaatacaaatttttaaactgatgcttcattttgctacaaaataatttggagtaaatgtttgatatgatttatttatgaaacctaatgaagcagaattaaatactgtattaaaataagttcgctgtctttaaacaaatggagatgactactaagtcacattgactttaacatgaggtatcactataccttatttgttaaaatatatactgtatacattttatatattttaacacttaatactatgaaaacaaataattgtaaaggaatcttgtcagattacagtaagaatgaacatatttgtggcatcgagttaaagtttatatttcccctaaatatgctgtgattctaatacattcgtgtaggttttcaagtagaaataaacctcgtaacaagttactgaacgtttaaacagcctgacaagcatgtatatatgtttaaaattcaataaacaaagacccagtccctaaattatagaaatttaaattattcttgcatgtttatcgacatcacaacagatccctaaatccctaaatccctaaagattagatacaaattttttaccacagtatcacttgtcagaatttatttttaaatatgattttttaaaactgccagtaagaaattttaaattaaacccatttgttaaaggatatagtgcccaagttatatggtgacctacctttgtcaatacttagcattatgtatttcaaattatccaatatacatgtcatatatatttttatatgtcacatatataaaagatatgtatgatctatgtgaatcctaagtaaatattttgttccagaaaagtacaaaataataaaggtaaaaataatctataattttcaggaccacagactaagctgtcgaaattaacgctgatttttttagggccagaataccaaaatggctcctctcttcccccaaaattggacaatttcaaatgcaaaataattcattatttaatatatgagttgcttcctctatttggtttccttaaaaaaaaaaaaaactctcataggacatgtttcattttgttcctttcaggagtagtaaattagacgttttccccatataaagcttttttctaccagaaagatacttctggtagaagaagagaaaggagctctttatggttcacacgactgtctcctgtcctaactactttgcttaaagtgctcaaattccatcactactcacagttgtctaatctaagtctaatcccctttgatctctcagactaccttcccttttatctctctactacttaataataagaatatctttttttcaaacttgaccttcattttgctttcacaatactatactctccatggattatcccttatctgaatccatctttataaccctattcctttctcatatttagtactgtgggccaatggacaaccttcaatcatcttttctacactgaccctcagacattctatctgctctcacggactcctttatttaccatgaataaagttccaaaatctacatattcatcccaagtctctttccagttccccttcttacattgcctatttgccatttctcccttcaataccctatacttcactcaaattcaacataccaaaaataaaaggccaggcacggtggctcacacctgtaatcccaggactttgggaggctgaggcaggtggatcacctgaggtcaggagtctgaccagcctgaccaatatggtgaaaccccgtctctacctaaaatacaaaaattagccaggcgtggtggcatgtgcctacagtcccagctactcaagaggctgagacaggagaatcgcttgaacccaggaggcggaggttgcagtgagctgagatcacaccaatgcactgggtgacagaacaagactgactcaaaaaaaaataaataacaaattccccagccccttactgctactgctatccctttctacccacctttccctcctttatactctttcacaccatcttcctcacttctttatatccattaatatgaccagcatgttcccagtcacagaagcctggaacccggaagacatctctggcttttcactcaactttgtaaactacctcttttgtatcataagccaccaagttcaatacaatcttctcttgaaacgtctcttaatcttataagctttcttccccaaagactgtctttaacttcagtgctagattatataagtagtctcttctttcctcctaattttacgtccctctccctgtcaatcttccgaaaaggaatttgtaatggctgcatactgcctggacctgtgtctttcaagctcatctactgaagaagtgtaacagcagaggataatgaaaacaaatccttttattgtctggagttacaggataaaataacttactatatgcacaaatttctttcagaatcttattgggatcttagcttaaatcttagaattttactttaaaattgcatatgaattgtgttttatactttataaatctatcttcatgcctgcagtggctcacacctgtaatccaagtattttgggaggccggggcgggagtactgcttgaacccaggagtccaagatcagcctgtgcaacacggcaaaactccacctctacaaaaaatacaaaaattagctgggtgtggtggcaggtgcctgtaatcccaactacttgggaggctgaggcaggagaatcgctggagcctgggaagtcaagcctgcagcgaaccatgatcctaacactgcattctagcctgggcaacagagtgagactctgtctcaaaaaaaatcttcatataaaaatatttatttccccccaagtatttaaaaagtgatgttcctagaagatgtgtcatgtttatcctgtgaacttgcacgtcccatatagttgtgccctcacaagaatgtatactccaattagaagagtataggcctttggaacaaaatccaaaatccttccaggttttcaaaagtctctatcacctggccccaaattacctcttcagccattttttcccacaacacaaaccttctgctctcatcaaaacgatctacttttaaacatctcctctatgccttcctaatgtattccatttgtctagaatgtctcc

SEQ ID NO: 3 - DNA, 13000 bp, Macaca mulatta
  misc_feature (4504)..(4523): n is a, c, g, or t
  misc_feature (5370)..(5795): n is a, c, g, or t
  misc_feature (7498)..(7517): n is a, c, g, or t
  misc_feature (9552)..(9895): n is a, c, g, or t
cccagctactgaggaggctgaggcaggagaatggcgtaaacccgggaggcggagcttgcagtgagctgagatctggccactgcaccccagcctgggcaacagagcaagactccgtctcaaaaaacaaaacaaaacaaaacaaaacaaaacaaaacaaagaatgtagtatatcaaaaagaggtaaccagtactacatatacattctgcacttggaaaatccctatatgttgattttatcattctcttagtcattcaataaacattgcttctacaatgtgtgaggcattactgtactaaagcattataaggaatatacattaaaaacacatacaaatcttgccaataaacggcttatagtataataggggagagaagttggcccatctatcttctccttcaactagcaagtagatgaaatatcagggtcaatagttgtaagccataaaagctgacagcttagttaagagaagttttgaaatatgtatttcatggccaaataattacaactgtaacttttctatttaaagaaggagaaaatttgaatttcttctctagctcaacatacacttttataattctataacatgaaccagagtaaagggtaagatggaaatgaagaatattttcttacccttttgtggttccatattggacacttaaaaatcatacacaacctaatcaaaagacataattcattaaaaaggtacgagaccaaaactaaaaaaatctagactataacaaaatttcccaatttacattatcttaatatgcaattaattttcaccagtaaaatactatactatgggtacaaatgcattgattagttctaattacaaaaatggctaatatataatattatgtagtgtttatgacacaccaggtaatgttctaagtgctttgaaaatataaacttttaatctttatacaaccctataaaataggtgtcattctcactggacagatgagaaaacaggggttcagaaatgtgaagtaatttgaccaaaggtcacaaaactgaagaatatcaaatccaggattctgattcaggcagtcttgttccagaatcatgctcttaaccactatggaatactacctgtattatagtattacatatactgtactataactattacacccaaaacccttaatactacctgtactataactattatacccaaaatcctgagtcatcaaaaagaagagcctctattttatacaatgaagaggcatttctaagaatagaaatttagggacgagcacagtggcttactcctgtaatatcagcactttgagaggctgatgtgggaagttcacttgaagtcaggagttcgaggccagcttggacaacatagtgagacccactctctacaaaatatttaaaaattagctgggcgtgttggcatgcatctatagtctcagctactggggaggctgagggaggaggctcactcaagcccaggaattcgtggctatagtgagctatgatcatgccactgtactccagcctggacaacagagcaagaccctgtctctaaaaaaaagaaaagaaaagaaatttggaaatggttcattttgtagtaacaatttataatttacactgaaattcattatgataaaacttttccctgtgttaaaaagatattaactttatgaaaaatttattttaggtaaggttgattatatatactcacacacatacacaggttaaaagttagtttcatgtgacataataactagcattttgagcactacctgtttgcccaacactgttctaagtgctctacatgtattattgttaaattatcataacactatgaattatgtactataattaccccagctttacagatgaggagactaatccaaggggaagttaagtaacttgtccaaggtcagacagcgagagctggctttggaccccactacagtctgactccagcacccatattcttaacaatttcaccatattaatatgtcaagattaagtagttttaaaggatactattttctcacaaagttcttaatatgaacacttaataagaataatcactaatattagtatttttctttttaacactaagttggaagcacagtggaacatttatttttagaaatattattaattggctgggctcacgcctgtaattgactgggctcatgtccgtaaattttgggaggccaaggcaaaagaatcgcttgagcccaatagttccagaccagcataggcaatacattaagacatcgtctttaaaaaaacaaagttattaatctcttctttttgttaaatgtatattatcaaaattgttacactaagctcacaaacttcagaaaaacttatgatgggtaagttgcttgtgacattgaaagtatttaagattcaattctgtttgatcctagaagaccacatatccattgttccttcagtaaacacatgataaagagcctagaacagagagacagagaacacagtggagaaaggggagtgaaatgtctttaatgacacttactatatgtgggattttgtgataatatacaaggatgattaagacatataaggtgatgcaaaaaaaccatattaacaattatagtgacaaaaataaggagtacataattatacgttgatttatacagagtaccaaaggaatacagcattgagagctgtaccactacccgagggaatggagaaaggcttcagagagaaagtgttttttgggatggatcaatgtttccaaaagaaccgaagtgcagtttgagaaacgcatacttaattaattcttttcctcaactttaataataaatttactcaacaaaaaagtttatttttgacttgtaaatctcttaaaatcataaaaaagtaaaatcagcttttaaaaacaggtagtcaccatatcattgaatgtgcagtttataatacagcaaagttaaatacaatttcaaattacctattaagttagttgctcatttctttgatttcatttagcattgatgtaactcaatgtggaagaaggttacattcgtgcaagttaacatggcttaatgattaactatattcacctgccaaccttgccttttctgtggcaaatattggtatatatagagttaagaagtctaggtctgcttccagaagaacacagttccacgttgcttgaaattgaaaatcaggataaaaatgttcacaattaagctccttctttttattgttcctctagttatttcctccagaattgaccaagacaattcatcatttgattctgtatctccagagccaaaatcaagatttgctatgttagacgatgtaaaaattttagccaatggcctccttcagttgggacatggtcttaaagactttgtccataagactaagggccaaattaatgacatatttcaaaaactcaacatatttgatcagtctttttatgatctatcactgcaaaccagtgaaatcaaagaagaagaaaaggaactgagaagaactacatataaactacaagtcaaaaatgaagaggtaaagaatatgtcacttgaactcaactcaaaacttgaaagcctcctagaagaaaaaattctacttcaacaaaaagtgaaatatttagaagagcaactaactaacttaattcaaaatcaacctgaaactccagaacatccagaagtaacttcacttaaagtaagtagaaaataaagagggttcatgtttatgttttcaatgtggaacattaaaaaaaaatatttctaaggcatgctacttgaaatactttgttgcattgttggaatacttttttttccaagaaaaataatctccagaaaataaaatttcccattataattttgttagtttttgtttccctaatgttatatatgaaaacactgaaactttacattttatatgaaaattacaaattggttaagtaacacaatctagaacactatgtcattacactattgcaaattactgaaggtaagtaaaattttttaaaaatttaaaactattctctagtgtttaaaacagattaaagtaatacagtaaatggaaaagatttattcctattaaaatatgctgggctttttctcttaattgaagttcagaaaaacaaatcttagagatagcacaatttaaataaaatgttaagaacaaaaatacatgctatttgaaagaagcatacaaggggaaggaattgccaatattcatttttcaaatccattattagtttaaaaatttagattatgatagtgttacaggaaattaaaactctaatagaaaagaagaaagtaacttataaccaatctaatctctatattcagagttttgtagaaaaacaagataatagcatcaaagaccttctccagactgtggaagaacaatataagcaattaaaccaacagcacagtcaaataaaagaaatagaaaatcaggtaagtcaatattttaatggtatgtcccatctttcacacaggtttgtaaaacattgaatcctaaaattatttacagctttaactggatcatgannnnnnnnnnnnnnnnnnnngaaaataattaattcatagcagccaatgtcatcctattaaaattcaaattagatcatgtttctccttgctcaaaaccacacaatagctttccatctcactcatattggctctttagaccaagattacccgacccttcatcatctcactgacttcacctcctctactctagtcattttgatcgctttaccggtattcaaacacatcaaacatgctgccacctcgaagcctttgcccttgttgtttcctctatctggaatgctcttttgtcctggtatctacagggcccactctttgatctcccttagggtcgttatcaaacataaaattctcaatgaagatttccaaggtcacttaaccaaaaattacaactgcctggtcccatccctgaaaacttctacttccttaactacttttctcctgcacactcacctttatttaacataaattttagttatttatctcttctattcctgcactaaaatgtaagctctgtgaataaaggggtttttttccattatcttcatattttccattatttgtatatactccagaatatagaatactgtatggcacatactaggcatttctgttgaattaataaatgtaatgtcatattcacacagagtgtgtgctataattattattacttggattactagaaatagtgtgcctcataattaaaggtcaacattcaacaacgtaattaatctacaatgtaaacaactggtgaagtgaggggggaagcacttgtttagaataaagctatgtcagaatctaagtattctaatatacagtaaatagttaaaaaatattaataatactcttaaacagtcattcaagaggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacgttaaaatcacatagttacttagtagaaaagagtaatatccagcaagtaaactttacaatagatccttttaaataaggtcctaggaaatgtcatttatgccaggatcaaaaaactaacactcataatgcaagatattatatattctgcttttcttactgtcaatgagaaaaactatcattcaataaattgcaaacccaacacacttaaataaaatgttattgcaaaactaacgataaactactgaatatatggaaagtaagcaaataaacttgccaacctgccaacatctacagatgtgtttacaggtcaaaaattatcaaattatcaagaaagccaggttcaaattatgtattatgtctttaaagcaggtctgaagatcagtaagacctaaaactgaaaattattgaacttaaaatctgaacagaatatcaaacatattctattcatataaaaaaaaatacattacaacattctaagcaaagcagtctctacttttggccttgttctgttttctgaccaatgtctgcttttttgccttgttttatttttttaatttattaaataatgtccctgattaaatattttgagaacaggtaatctgtacaatctgaataacactgtttatctaaatatcaaacaccataacattatgaactgaaagacaaactgtacttttgacatccttactcagatctcccctaattatgtattcagtatcattttaaaaaacagatttatattcttttatcagctcagaatgactaatattcaagaacccacagaaatttctctatcttccaagccaagagcaccaagaactactccctttcttcagctgaatgaaataagaaatgtaaaacatgatggtaagacactttggtgggtttccttcttgaagctattatcaaattccctattcttaggacttgttctagactaaaagattaagagatagccatcaaatacaatggatcatcctaaattggatcctggggttcttcttctaccctataaaagatatacctaagacaatcacagaaatataaatatggacttgattattagataatatagaaggtttattaattttcttagacgtgatcatggtattgcaattttaaaggagaacaacctcctgtttaagagatacatgctgaaatatttaaggagttaaaggtcactggactcctggctgggtgacagaacaagactctgtctctaaaaaaataattttttaaaagaaaatagtttggtaagaatgattcttacattcttaaataacatgccatcgaagaaaaatgctttaacataaacattactgaaaaaaatgctacatttgccacaatttcataaaatgtcaagtgaaatctcaagctccaaagacattattcctattactaaatctgatgtaataacattttattgattctaggcattcctgctgattgtaccaccatttacaatagaggtgaacatataagtggcatgtatgccatcagacccagcaactctcaagtttttcatgtctactgtgatgttgtatcaggtaaaacctgtctaaggagaatagacagtagttagttcaagttactcagtatgtattaggaagattaacctggttataattgttttatacatatatatatatgaaatatatgtaacatgagtattagtataaatctaatacttttatcttgnnnnnnnnnnnnnnnnnnnnatggatcacaaaacttcaatgaaacgtgggagaactacaaatatggtttcgggaggcttgatggtaaggtgactacattcaatcattcattcatttgctaatctacaaatatttactgagaacctattgtggactgggcattaggaaaagtagtaatgaagaagcagcagtctcagccttcatataatttattatcaaacaattacacatttgttagtaaattattacaactgttataatttgatttatatttatcacagttacatgtctgttcttaaatatacttatcacaatttaatttgatggcttacaatgatcataactataattattaaagacaattctgattaaatgttatataagtagtaactgttacaaataagctgtgaaaagaaccactcctagcattagtcactctattctctcattaacgttttacgtatcaattaattggaagttaaaaggaccaagaaactcagacatacagtataaattttaaaatttcaattatttaaatgtaatatatagaatgtgtggcttataatgaattagttaactcaatgcaaattattctgattacaaaataatgttaaataagcaagataaaataacagatgtttaaaatccaaaaagcacatacaaaaatccatgaatgatgtctaagtactcacttataaagtagaagacattcattattatatcaaatttttaaatgctcagtactatttgcccatttaaaaattttgtattcaaattacccgttaaagccctacctagatggtatactccgtgatatgttttgtagctccaaatcttctaatagtgagtgtaaccccaaaataaaaggctgacaggtaagttaagaatactcacttaattctggtaagaaactaacccatttgtacttgtatttaccagcaatccttaaaatgaagcttcctactaactcaatagcaataagacaacagtgactgtttaatgaaaacagtaatttattaagcattttactaaatactttaataaaaaggattgtgataaaaagtctatttatatttgttatttatgtttttaattccaaataaaaataatttttaaaattatagaaaaaagttattaagaaccatgctttttcatttaaaatgatttttaaaatttattcctgtctttttctacaaagaaaacatatattaagcaaataccaaaggccaggtttagacttattattactcaagtctctgggaatacttaacaaaaatctcttgactgtatatggatgttaataaatacctgatagtaaagtttatccatataaagacttacaagaaaatattcctctaccaatgacgagactttaaagtatctataataatgtaacatatttcactggttaaatatgtcttgtaatatgcattatagaaaggataatctgactttcagttctattaatatttttaacattattgtgcatatagatatcttcaataaaattgttttaaaaggtattattttaagatactctaaaatgatcaagggattcaagactaaacaactcaattagttgcaccaataaaaaacacttaaaaaaacagtgtccaacctgtagttaataattcacagatttttaaaacttttcttttcaggagaattctggttgggcctagagaagatatactccatagtgaagcaatctaattacgttttacgaattgagttggaagactggaaagacaacaaacattatattgaatattctttttacttgggaaatcacgaaaccaactatacgctacatgtagttaagattactggcaatgtccccaatgcaatcccggaaaacaaagatttggtgttttctacttgggatcacaaagcaaaaggacacttcagctgtccagagagttattcaggtatctttttctgataacaatactttattttcatatcttcaaagtatctgcccacattattagctattatctgcaatgacaacttttaaaaatccgaatcccaaataagcgttttctttctagatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacactataatatttattaaaaaggaagataaactcatggggaaatacagtaactacatacgagtctgtacccactaaactgcgtatctatctcctttaggaggctggtggtggcatgatgagtgtggagaaaacaacctaaatggtaaatataacaaaccaagaacaaaatctaagccagagcggagaagaggattatcctggaagtctcaaaatggaaggttatactctataaaatcaaccaaaatgttgatccatccaacagattcagaaagctttgaatgaactgaggcaaatttaaaaggcaataaattaaacattaaactcattccaagttaatgtggtttaataatctggtattaaatccttaagagaaggcttgagaaatagatttttttatcttaaagtcactgtcaatttaagattaaacatacaatcacataaccttaaagaataccatttacatttctcaatcaaaattcctacaacactatttgttttatattttgtgatgtgggaatcaattttagatggtcgcaatctaaattataatcaacaggtgaacttactaaataacttttctaaataaaaaacttagagactttaattttaaaagtcatcatatgagctaatatcacaattttcccagtttaaaaaactagttttcttgttaaaactctaaacttgactaaataaagaggactgataattatacagttcttaaatttgttgtaatattaatttcaaaactaaaaattgtcagcacagagtatgtgtaaaaatctgtaatataaatttttaaactgatgcctcattttgctacaaaataatctggagtaaatttttgataggatttatttatgaaacctaatgaagcaggattaaatactgtattaaaataggttcgctgtcttttaaacaaatggagatgatgattactaagtcacattgactttaatatgaggtatcactataccttaacatatttgttaaaacgtatactgtatacattttgtgtattttaatacttaatactatgaaaacaagtaattgtaaacgtatcttgtcagattacaataggaatgaacatattggtgacatcgagttaaagtttatatttcccctaaatatgctgcgattccaatatattcatgtaggttttcaagcagaaataaaccttgtaacaagttactgactaaacagcctgacaagtatgtatatatgtttaaaattcaataaataaagacccagtcttctaaattataaaaatttaaattagtcttgcacaaattaaattattcatcacaaaagatgtattgttatttttaagtcatttaagccctaaatccctaaagattagatacaaatttttttttgccagagtataaattgtcagaatttatttttaaatatattttttaaaactaccagtaagaaattttaaattaaacccatttgttaaaggatatagtgcccaagttatacggtgacctacctttgtcaatatttagcattatgtatttcaaattatccaatatacatgtcatatatatttttatatgttgcatatataaaagatatacacgatttatgtgaatcctatgtaaatattttgttccagaaaagtacaaaataataaaggtaaaaataatccataattttcaggaccacagactaagctgtcaaaattaacattgattttttttagggccagaataccaaaatagctcctctcttccccaaaaattggacaatttcaaatgcaaaataattcattatttaatatatgagttgcttccactatttggtttcctttaaaaaaaaaaaaaaaacactctcataggacatgtttcattttgttccttttaggagtagtaaattagattttttccccatacaaagctttcttttaccagaaagatacttctggcagaagaggagaaaggagctcttttctttatggttcacacgactgtctcctgtcctcactactttgcttaaagtgctcaaattccaccactaactcacagttgtctaatctaagcaaagtctaatcccctttgatctctgagtctaccttccctttcatctctctactacttactaatgtgaatatctttttttcaaacttgaccttcattttgctttcacaatactatactctccatggattttcccttacttgaatccatctttataaccctattcctttctcatatttagtactgtgggccaatggacaacctttaatcatcttttctacactgactctcagatattctatctgctctcacggactcatctatgtaccatgaataaagttccaaaatctacgtattcatcctaagtctctttccagttccccttcttacattgcctatctgccatttctccctttaataacctatacttcacttaaattcaacatatcaaaaataacaggccgggcacggtggctcatgactgtaatcccagcactttgggaggccgaggcgggtggatcacctgaggtcaggagtttcagaccagcctgaccaacagggtgaaaccccgtctccacttaaaatacaaaaattagccaggtgtggtggcatgtgcctatagtcccagttactcaagaggctgagacaggagaattgcttgaacccaggaggcggaggttgcagtgagctgagatcacaccactgcactccatcctgggtgacagaacaagactgactcaaaaaaataaataattcaccagcccctgactgctactgctatctctttctacccaactttccctcctttcgactctgtcacaccatctttctcacttctttatatccattaatatgaccagcatgttcccagtcacagaagcctgaaacctggaagacatctctagcttttccctcaacttcgtaaactacttcttttgtataagccaccaagttcaatacaatcttctcttgaaacatctcttaatcttataagctttcttccccaaagtctgtctttaacttgagtgctagattatattagtctcctctttcctcctaattttatgtccctctccctgtcaatcttctgaaaagaaatttgtaatggctgcatattgcttgga

SEQ ID NO: 4 - DNA, 25 bp, Artificial sequence
  Primer
ccgtggaagaccaatataaacaatt

SEQ ID NO: 5 - DNA, 28 bp, Artificial sequence
  Primer
agtccttctgagctgattttctatttct

SEQ ID NO: 6 - DNA, 21 bp, Artificial sequence
  Probe
aaccaacagcatagtcaaata

SEQ ID NO: 7 - DNA, 23 bp, Artificial sequence
  Primer
cttcaatgaaacgtgggagaact

SEQ ID NO: 8 - DNA, 22 bp, Artificial sequence
  Primer
tctctaggcccaaccaaaattc

SEQ ID NO: 9 - DNA, 24 bp, Artificial sequence
  Probe
aaatatggttttgggaggcttgat

SEQ ID NO: 10 - DNA, 21 bp, Artificial sequence
  Primer
aaattttagccaatggcctcc

SEQ ID NO: 11 - DNA, 21 bp, Artificial sequence
  Primer
tgtcattaatttggcccttcg

SEQ ID NO: 12 - DNA, 32 bp, Artificial sequence
  Probe
tcagttgggacatggtcttaaagactttgtcc

SEQ ID NO: 13 - DNA, 27 bp, Artificial sequence
  Synthetic oligonucleotide
gcgtttgctcttcttcttgcgtttttt

SEQ ID NO: 14 - DNA, 20 bp, Artificial sequence
  Synthetic oligonucleotide
tgaattaatgtccatggact

SEQ ID NO: 15 - DNA, 20 bp, Artificial sequence
  Synthetic oligonucleotide
agttcttggtgctcttggct

SEQ ID NO: 16 - DNA, 20 bp, Artificial sequence
  Synthetic oligonucleotide
gttgtctttccagtcttcca

SEQ ID NO: 17 - DNA, 20 bp, Artificial sequence
  Synthetic oligonucleotide
gctttgtgatcccaagtaga

SEQ ID NO: 18 - DNA, 20 bp, Artificial sequence
  Synthetic oligonucleotide
ggttgttttctccacactca

SEQ ID NO: 19 - DNA, 20 bp, Artificial sequence
  Synthetic oligonucleotide
accttccattttgagacttc

SEQ ID NO: 20 - DNA, 20 bp, Artificial sequence
  Synthetic oligonucleotide
tacacatactctgtgctgac

SEQ ID NO: 21 - DNA, 20 bp, Artificial sequence
  Synthetic oligonucleotide
tttcagcatgtatctcttaa

SEQ ID NO: 22 - DNA, 20 bp, Artificial sequence
  Synthetic oligonucleotide
accaggttaatcttcctaat

SEQ ID NO: 23 - DNA, 20 bp, Artificial sequence
  Synthetic oligonucleotide
agttatgatcattgtaagcc

SEQ ID NO: 24 - DNA, 20 bp, Artificial sequence
  Synthetic oligonucleotide
ggagtggttcttttcacagc

SEQ ID NO: 25 - DNA, 20 bp, Artificial sequence
  Synthetic oligonucleotide
tggtccttttaacttccaat

SEQ ID NO: 26 - DNA, 20 bp, Artificial sequence
  Synthetic oligonucleotide
gcattgagttaactaattca

SEQ ID NO: 27 - DNA, 20 bp, Artificial sequence
  Synthetic oligonucleotide
catccatatacagtcaagag

SEQ ID NO: 28 - DNA, 20 bp, Artificial sequence
  Synthetic oligonucleotide
cacttgtatgttcacctctg

SEQ ID NO: 29 - DNA, 20 bp, Artificial sequence
  Synthetic oligonucleotide
tctattcgatgttgaattaa

SEQ ID NO: 30 - DNA, 20 bp, Artificial sequence
  Synthetic oligonucleotide
ttgattttcaatttcaagca

SEQ ID NO: 31 - DNA, 20 bp, Artificial sequence
  Synthetic oligonucleotide
ggctctggagatagagaatc

SEQ ID NO: 32 - DNA, 20 bp, Artificial sequence
  Synthetic oligonucleotide
tcttgattttggctctggag

SEQ ID NO: 33 - DNA, 20 bp, Artificial sequence
  Synthetic oligonucleotide
gtcattaatttggcccttcg

SEQ ID NO: 34 - DNA, 20 bp, Artificial sequence
  Synthetic oligonucleotide
ttcactggtttgcagcgata

SEQ ID NO: 35 - DNA, 20 bp, Artificial sequence
  Synthetic oligonucleotide
cttagattttgctcttggtt

SEQ ID NO: 36 - DNA, 20 bp, Artificial sequence
  Synthetic oligonucleotide
gcttagattttgctcttggt

SEQ ID NO: 37 - DNA, 20 bp, Artificial sequence
  Synthetic oligonucleotide
ggcttagattttgctcttgg

SEQ ID NO: 38 - DNA, 20 bp, Artificial sequence
  Synthetic oligonucleotide
gctcatatgatgccttttaa

SEQ ID NO: 39 - DNA, 20 bp, Artificial sequence
  Synthetic oligonucleotide
agctcatatgatgcctttta

SEQ ID NO: 40 - DNA, 20 bp, Artificial sequence
  Synthetic oligonucleotide
tagctcatatgatgcctttt

SEQ ID NO: 41 - DNA, 20 bp, Artificial sequence
  Synthetic oligonucleotide
tattagctcatatgatgcct

SEQ ID NO: 42 - DNA, 20 bp, Artificial sequence
  Synthetic oligonucleotide
ccacaaatatgttcattctt

SEQ ID NO: 43 - DNA, 20 bp, Artificial sequence
  Synthetic oligonucleotide
tgccacaaatatgttcattc

SEQ ID NO: 44 - DNA, 20 bp, Artificial sequence
  Synthetic oligonucleotide
taaactttaactcgatgcca

SEQ ID NO: 45 - DNA, 20 bp, Artificial sequence
  Synthetic oligonucleotide
acgaggtttatttctacttg

SEQ ID NO: 46 - DNA, 20 bp, Artificial sequence
  Synthetic oligonucleotide
catgcttgtcaggctgttta

SEQ ID NO: 47 - DNA, 20 bp, Artificial sequence
  Synthetic oligonucleotide
tacatgcttgtcaggctgtt

SEQ ID NO: 48 - DNA, 20 bp, Artificial sequence
  Synthetic oligonucleotide
tccaactcagaaattcattg

SEQ ID NO: 49 - DNA, 20 bp, Artificial sequence
  Synthetic oligonucleotide
ttgctgggtattactctttt

SEQ ID NO: 50 - DNA, 20 bp, Artificial sequence
  Synthetic oligonucleotide
tttgcttgctgggtattact

SEQ ID NO: 51 - DNA, 20 bp, Artificial sequence
  Synthetic oligonucleotide
tggcatgaatgatatttcct

SEQ ID NO: 52 - DNA, 20 bp, Artificial sequence
  Synthetic oligonucleotide
gcaataccatgatcacatct

SEQ ID NO: 53 - DNA, 20 bp, Artificial sequence
  Synthetic oligonucleotide
actccgtaaatatttcagca

SEQ ID NO: 54 - DNA, 20 bp, Artificial sequence
  Synthetic oligonucleotide
tggcaaatgtagcatttttt

SEQ ID NO: 55 - DNA, 20 bp, Artificial sequence
  Synthetic oligonucleotide
aagccatacattctatatat

SEQ ID NO: 56 - DNA, 20 bp, Artificial sequence
  Synthetic oligonucleotide
tcagctatttattaacatcc

SEQ ID NO: 57 - DNA, 20 bp, Artificial sequence
  Synthetic oligonucleotide
gaggaatatttgcaagtctt

SEQ ID NO: 58 - DNA, 20 bp, Artificial sequence
  Synthetic oligonucleotide
ttggtagaggaatatttgca

SEQ ID NO: 59 - DNA, 20 bp, Artificial sequence
  Synthetic oligonucleotide
accagtgaaatgtgttacat

SEQ ID NO: 60 - DNA, 20 bp, Artificial sequence
  Synthetic oligonucleotide
tgaaagtctgattatccttt

SEQ ID NO: 61 - DNA, 20 bp, Artificial sequence
  Synthetic oligonucleotide
atttaatgggtacagactcg

SEQ ID NO: 62 - DNA, 20 bp, Artificial sequence
  Synthetic oligonucleotide
ataccatgatcacatctaag

SEQ ID NO: 63 - DNA, 20 bp, Artificial sequence
  Synthetic oligonucleotide
gacctttaactccgtaaata

SEQ ID NO: 64 - DNA, 20 bp, Artificial sequence
  Synthetic oligonucleotide
tctggagtccagtgaccttt

SEQ ID NO: 65 - DNA, 20 bp, Artificial sequence
  Synthetic oligonucleotide
atgtaagaatcatcttacca

SEQ ID NO: 66 - DNA, 20 bp, Artificial sequence
  Synthetic oligonucleotide
agcatttttcttagatggcg

SEQ ID NO: 67 - DNA, 20 bp, Artificial sequence
  Synthetic oligonucleotide
cattttatgaagttgtggca

SEQ ID NO: 68 - DNA, 20 bp, Artificial sequence
  Synthetic oligonucleotide
cacttgacattttatgaagt

SEQ ID NO: 69 - DNA, 20 bp, Artificial sequence
  Synthetic oligonucleotide
tcctggtccttttaacttcc

SEQ ID NO: 70 - DNA, 20 bp, Artificial sequence
  Synthetic oligonucleotide
gacatcattcatggattttt

SEQ ID NO: 71 - DNA, 20 bp, Artificial sequence
  Synthetic oligonucleotide
agtacttagacatcattcat

SEQ ID NO: 72 - DNA, 20 bp, Artificial sequence
  Synthetic oligonucleotide
ggtcaaatagtactgagcat

SEQ ID NO: 73 - DNA, 20 bp, Artificial sequence
  Synthetic oligonucleotide
ggtagtttgaatacaaaatt

SEQ ID NO: 74 - DNA, 20 bp, Artificial sequence
  Synthetic oligonucleotide
ctctgttataaatggtggta

SEQ ID NO: 75 - DNA, 20 bp, Artificial sequence
  Synthetic oligonucleotide
ttcttggtgctcttggcttg

SEQ ID NO: 76 - DNA, 20 bp, Artificial sequence
  Synthetic oligonucleotide
ggtacattcagcaggaatgc

SEQ ID NO: 77 - DNA, 20 bp, Artificial sequence
  Synthetic oligonucleotide
ggacattgccagtaatcgca

SEQ ID NO: 78 - DNA, 20 bp, Artificial sequence
  Synthetic oligonucleotide
cactcatcatgccaccacca

SEQ ID NO: 79 - DNA, 20 bp, Artificial sequence
  Synthetic oligonucleotide
ctccacactcatcatgccac

SEQ ID NO: 80 - DNA, 20 bp, Artificial sequence
  Synthetic oligonucleotide
tttctccacactcatcatgc

SEQ ID NO: 81 - DNA, 20 bp, Artificial sequence
  Synthetic oligonucleotide
gctgacgatttttagttttg

SEQ ID NO: 82 - DNA, 20 bp, Artificial sequence
  Synthetic oligonucleotide
cacatactctgtgctgacga

SEQ ID NO: 83 - DNA, 20 bp, Artificial sequence
  Synthetic oligonucleotide
tttacacatactctgtgctg

SEQ ID NO: 84 - DNA, 20 bp, Artificial sequence
  Synthetic oligonucleotide
gctttcttaccagaattaag

SEQ ID NO: 85 - DNA, 20 bp, Artificial sequence
  Synthetic oligonucleotide
gttgctttcttaccagaatt

SEQ ID NO: 86 - DNA, 20 bp, Artificial sequence
  Synthetic oligonucleotide
ataccagattattagaccac

SEQ ID NO: 87 - DNA, 20 bp, Artificial sequence
  Synthetic oligonucleotide
gcttcattttaaggattgct

SEQ ID NO: 88 - DNA, 20 bp, Artificial sequence
  Synthetic oligonucleotide
gcttaatgtatgctttcttt

SEQ ID NO: 89 - DNA, 20 bp, Artificial sequence
  Synthetic oligonucleotide
gttaagtattcctagagact

SEQ ID NO: 90 - DNA, 20 bp, Artificial sequence
  Synthetic oligonucleotide
tccatatttgtatttctctg

SEQ ID NO: 91 - DNA, 20 bp, Artificial sequence
  Synthetic oligonucleotide
cgtaagtttatcttcctttc

SEQ ID NO: 92 - DNA, 20 bp, Artificial sequence
  Synthetic oligonucleotide
cacattaacttggaatgagg

SEQ ID NO: 93 - DNA, 20 bp, Artificial sequence
  Synthetic oligonucleotide
ccagattattagaccacatt

SEQ ID NO: 94 - DNA, 20 bp, Artificial sequence
  Synthetic oligonucleotide
taccagattattagaccaca

SEQ ID NO: 95 - DNA, 20 bp, Artificial sequence
  Synthetic oligonucleotide
gctttctcttaaggatttaa

SEQ ID NO: 96 - DNA, 20 bp, Artificial sequence
  Synthetic oligonucleotide
ctcaagctttctcttaagga

SEQ ID NO: 97 - DNA, 20 bp, Artificial sequence
  Synthetic oligonucleotide
tctcaagctttctcttaagg

SEQ ID NO: 98 - DNA, 20 bp, Artificial sequence
  Synthetic oligonucleotide
ccatttgtttaaagacagcg

SEQ ID NO: 99 - DNA, 20 bp, Artificial sequence
  Synthetic oligonucleotide
acttagtagtcatctccatt

SEQ ID NO: 100 - DNA, 20 bp, Artificial sequence
  Synthetic oligonucleotide
gacttagtagtcatctccat

SEQ ID NO: 101 - DNA, 20 bp, Artificial sequence
  Synthetic oligonucleotide
tgacttagtagtcatctcca

SEQ ID NO: 102 - DNA, 20 bp, Artificial sequence
  Synthetic oligonucleotide
gtcaatgtgacttagtagtc

SEQ ID NO: 103 - DNA, 20 bp, Artificial sequence
  Synthetic oligonucleotide
accatataacttgggcacta

SEQ ID NO: 104 - DNA, 20 bp, Artificial sequence
  Synthetic oligonucleotide
ggtcaccatataacttgggc

SEQ ID NO: 105 - DNA, 20 bp, Artificial sequence
  Synthetic oligonucleotide
gacaaaggtaggtcaccata

SEQ ID NO: 106 - DNA, 20 bp, Artificial sequence
  Synthetic oligonucleotide
gccaatatgagtgaaatgga

SEQ ID NO: 107 - DNA, 20 bp, Artificial sequence
  Synthetic oligonucleotide
tttctaaacaagtgcttccc

SEQ ID NO: 108 - DNA, 20 bp, Artificial sequence
  Synthetic oligonucleotide
ctgcatattagaatacatgg

SEQ ID NO: 109 - DNA, 20 bp, Artificial sequence
  Synthetic oligonucleotide
cataatttgaaccaggcttt

SEQ ID NO: 110 - DNA, 16 bp, Artificial sequence
  Synthetic oligonucleotide
aaatcttgattttggc

SEQ ID NO: 111 - DNA, 16 bp, Artificial sequence
  Synthetic oligonucleotide
ttcttggtgctcttgg

SEQ ID NO: 112 - DNA, 16 bp, Artificial sequence
  Synthetic oligonucleotide
cgtggaactgttttct

SEQ ID NO: 113 - DNA, 16 bp, Artificial sequence
  Synthetic oligonucleotide
cttgatcaattctgga

SEQ ID NO: 114 - DNA, 16 bp, Artificial sequence
  Synthetic oligonucleotide
gtcttgatcaattctg

SEQ ID NO: 115 - DNA, 16 bp, Artificial sequence
  Synthetic oligonucleotide
tggctctggagataga

SEQ ID NO: 116 - DNA, 16 bp, Artificial sequence
  Synthetic oligonucleotide
tgattttggctctgga

SEQ ID NO: 117 - DNA, 16 bp, Artificial sequence
  Synthetic oligonucleotide
cttgattttggctctg

SEQ ID NO: 118 - DNA, 16 bp, Artificial sequence
  Synthetic oligonucleotide
ggtgctcttggcttgg

SEQ ID NO: 119 - DNA, 16 bp, Artificial sequence
  Synthetic oligonucleotide
atcttctctaggccca

SEQ ID NO: 120 - DNA, 16 bp, Artificial sequence
  Synthetic oligonucleotide
gttgtctttccagtct

SEQ ID NO: 121 - DNA, 16 bp, Artificial sequence
  Synthetic oligonucleotide
gtttgttgtctttcca

SEQ ID NO: 122 - DNA, 16 bp, Artificial sequence
  Synthetic oligonucleotide
gtgatttcccaagtaa

SEQ ID NO: 123 - DNA, 16 bp, Artificial sequence
  Synthetic oligonucleotide
tggatcaacattttgg

SEQ ID NO: 124 - DNA, 16 bp, Artificial sequence
  Synthetic oligonucleotide
gaatctgttggatgga

SEQ ID NO: 125 - DNA, 16 bp, Artificial sequence
  Synthetic oligonucleotide
ttctgaatctgttgga

SEQ ID NO: 126 - DNA, 16 bp, Artificial sequence
  Synthetic oligonucleotide
gttcattcaaagcttt

SEQ ID NO: 127 - DNA, 16 bp, Artificial sequence
  Synthetic oligonucleotide
cagttcattcaaagct

SEQ ID NO: 128 - DNA, 16 bp, Artificial sequence
  Synthetic oligonucleotide
ttaacttggaatgagg

SEQ ID NO: 129 - DNA, 16 bp, Artificial sequence
  Synthetic oligonucleotide
agaccacattaacttg

SEQ ID NO: 130 - DNA, 16 bp, Artificial sequence
  Synthetic oligonucleotide
agattattagaccaca

SEQ ID NO: 131 - DNA, 16 bp, Artificial sequence
  Synthetic oligonucleotide
ccagattattagacca

SEQ ID NO: 132 - DNA, 16 bp, Artificial sequence
  Synthetic oligonucleotide
atctatttctcaagct

SEQ ID NO: 133 - DNA, 16 bp, Artificial sequence
  Synthetic oligonucleotide
atagacagtgacttta

SEQ ID NO: 134 - DNA, 16 bp, Artificial sequence
  Synthetic oligonucleotide
atactctgtgctgacg

SEQ ID NO: 135 - DNA, 16 bp, Artificial sequence
  Synthetic oligonucleotide
actctgtgctgacgat

SEQ ID NO: 136 - DNA, 16 bp, Artificial sequence
  Synthetic oligonucleotide
acatactctgtgctga

SEQ ID NO: 137 - DNA, 16 bp, Artificial sequence
  Synthetic oligonucleotide
gtagcaaaatgaagca

SEQ ID NO: 138 - DNA, 16 bp, Artificial sequence
  Synthetic oligonucleotide
tcaaacatttactcca

SEQ ID NO: 139 - DNA, 16 bp, Artificial sequence
  Synthetic oligonucleotide
taaagacagcgaactt

SEQ ID NO: 140 - DNA, 16 bp, Artificial sequence
  Synthetic oligonucleotide
tgtttaaagacagcga

SEQ ID NO: 141 - DNA, 16 bp, Artificial sequence
  Synthetic oligonucleotide
agtagtcatctccatt

SEQ ID NO: 142 - DNA, 16 bp, Artificial sequence
  Synthetic oligonucleotide
ttagtagtcatctcca

SEQ ID NO: 143 - DNA, 16 bp, Artificial sequence
  Synthetic oligonucleotide
acaaaggtaggtcacc

SEQ ID NO: 144 - DNA, 16 bp, Artificial sequence
  Synthetic oligonucleotide
tgacatgtatattgga

SEQ ID NO: 145 - DNA, 16 bp, Artificial sequence
  Synthetic oligonucleotide
gtacttttctggaaca

SEQ ID NO: 146 - DNA, 16 bp, Artificial sequence
  Synthetic oligonucleotide
cttggtctaaagagcc

SEQ ID NO: 147 - DNA, 16 bp, Artificial sequence
  Synthetic oligonucleotide
tctgtagatgttggca

SEQ ID NO: 148 - DNA, 16 bp, Artificial sequence
  Synthetic oligonucleotide
ataatttgaaccaggc

SEQ ID NO: 149 - DNA, 16 bp, Artificial sequence
  Synthetic oligonucleotide
agcagacattggtcgg

SEQ ID NO: 150 - DNA, 16 bp, Artificial sequence
  Synthetic oligonucleotide
cagattgtacagatta

SEQ ID NO: 151 - DNA, 16 bp, Artificial sequence
  Synthetic oligonucleotide
gtagaggaatatttgc

SEQ ID NO: 152 - DNA, 16 bp, Artificial sequence
  Synthetic oligonucleotide
aaagtctgattatcct

SEQ ID NO: 153 - DNA, 16 bp, Artificial sequence
  Synthetic oligonucleotide
tagtcttgaatccctt

SEQ ID NO: 154 - DNA, 16 bp, Artificial sequence
  Synthetic oligonucleotide
aagttgtcattgcaga

SEQ ID NO: 155 - DNA, 16 bp, Artificial sequence
  Synthetic oligonucleotide
tctgtataagtcccaa

SEQ ID NO: 156 - DNA, 16 bp, Artificial sequence
  Synthetic oligonucleotide
gatgcatgtatcccag

SEQ ID NO: 157 - DNA, 16 bp, Artificial sequence
  Synthetic oligonucleotide
gtaagtttatcttcct

SEQ ID NO: 158 - DNA, 16 bp, Artificial sequence
  Synthetic oligonucleotide
ctgttactgtatttcc

SEQ ID NO: 159 - DNA, 16 bp, Artificial sequence
  Synthetic oligonucleotide
tgcagcgatagatcat

SEQ ID NO: 160 - DNA, 16 bp, Artificial sequence
  Synthetic oligonucleotide
ctggtttgcagcgata

SEQ ID NO: 161 - DNA, 16 bp, Artificial sequence
  Synthetic oligonucleotide
ctttgatttcactggt

SEQ ID NO: 162 - DNA, 16 bp, Artificial sequence
  Synthetic oligonucleotide
gttcttctcagttcct

SEQ ID NO: 163 - DNA, 16 bp, Artificial sequence
  Synthetic oligonucleotide
gttagttagttgctct

SEQ ID NO: 164 - DNA, 16 bp, Artificial sequence
  Synthetic oligonucleotide
gtatgttcacctctgt

SEQ ID NO: 165 - DNA, 16 bp, Artificial sequence
  Synthetic oligonucleotide
gagttgctgggtctga

SEQ ID NO: 166 - DNA, 16 bp, Artificial sequence
  Synthetic oligonucleotide
aaacttgagagttgct

SEQ ID NO: 167 - DNA, 16 bp, Artificial sequence
  Synthetic oligonucleotide
gtccatggactacctg

SEQ ID NO: 168 - DNA, 16 bp, Artificial sequence
  Synthetic oligonucleotide
ccatctattcgatgtt

SEQ ID NO: 169 - DNA, 16 bp, Artificial sequence
  Synthetic oligonucleotide
tagattttgctcttgg

SEQ ID NO: 170 - DNA, 16 bp, Artificial sequence
  Synthetic oligonucleotide
ccattttgagacttcc

SEQ ID NO: 171 - DNA, 16 bp, Artificial sequence
  Synthetic oligonucleotide
tagagtataaccttcc

SEQ ID NO: 172 - DNA, 16 bp, Artificial sequence
  Synthetic oligonucleotide
ctcatcatgccaccac

SEQ ID NO: 173 - DNA, 16 bp, Artificial sequence
  Synthetic oligonucleotide
cacactcatcatgcca

SEQ ID NO: 174 - DNA, 16 bp, Artificial sequence
  Synthetic oligonucleotide
gagaaatgtaaacggt

SEQ ID NO: 175 - DNA, 16 bp, Artificial sequence
  Synthetic oligonucleotide
ctcatatgatgccttt

SEQ ID NO: 176 - DNA, 16 bp, Artificial sequence
  Synthetic oligonucleotide
agctcatatgatgcct

SEQ ID NO: 177 - DNA, 16 bp, Artificial sequence
  Synthetic oligonucleotide
ttagctcatatgatgc

SEQ ID NO: 178 - DNA, 16 bp, Artificial sequence
  Synthetic oligonucleotide
ttgtgatattagctca

SEQ ID NO: 179 - DNA, 16 bp, Artificial sequence
  Synthetic oligonucleotide
actgggaaagttgtga

SEQ ID NO: 180 - DNA, 16 bp, Artificial sequence
  Synthetic oligonucleotide
aatctgacaagattcc

SEQ ID NO: 181 - DNA, 16 bp, Artificial sequence
  Synthetic oligonucleotide
ctcgatgccacaaata

SEQ ID NO: 182 - DNA, 16 bp, Artificial sequence
  Synthetic oligonucleotide
taactcgatgccacaa

SEQ ID NO: 183 - DNA, 16 bp, Artificial sequence
  Synthetic oligonucleotide
tgcttgtcaggctgtt

SEQ ID NO: 184 - DNA, 16 bp, Artificial sequence
  Synthetic oligonucleotide
acatgcttgtcaggct

SEQ ID NO: 185 - DNA, 16 bp, Artificial sequence
  Synthetic oligonucleotide
cagttatgctgatgtg

SEQ ID NO: 186 - DNA, 16 bp, Artificial sequence
  Synthetic oligonucleotide
aagttttagagccatg

SEQ ID NO: 187 - DNA, 16 bp, Artificial sequence
  Synthetic oligonucleotide
ctgtcacttcaccaga

SEQ ID NO: 188 - DNA, 16 bp, Artificial sequence
  Synthetic oligonucleotide
tggattctgacatagc

SEQ ID NO: 189 - DNA, 16 bp, Artificial sequence
  Synthetic oligonucleotide
aaccttttagcagcac

SEQ ID NO: 190 - DNA, 16 bp, Artificial sequence
  Synthetic oligonucleotide
ttgcttgctgggtatt

SEQ ID NO: 191 - DNA, 16 bp, Artificial sequence
  Synthetic oligonucleotide
gtcttttatagggtgt

SEQ ID NO: 192 - DNA, 16 bp, Artificial sequence
  Synthetic oligonucleotide
ttgtcttaggtatgtc

SEQ ID NO: 193 - DNA, 16 bp, Artificial sequence
  Synthetic oligonucleotide
ctctgattgtcttagg

SEQ ID NO: 194 - DNA, 16 bp, Artificial sequence
  Synthetic oligonucleotide
gtatttctctgattgt

SEQ ID NO: 195 - DNA, 16 bp, Artificial sequence
  Synthetic oligonucleotide
tttttcttagatggcg

SEQ ID NO: 196 - DNA, 16 bp, Artificial sequence
  Synthetic oligonucleotide
gggctttcactggtag

SEQ ID NO: 197 - DNA, 16 bp, Artificial sequence
  Synthetic oligonucleotide
acagtcaagagatgtg

SEQ ID NO: 198 - DNA, 20 bp, Artificial sequence
  Synthetic oligonucleotide
atcttgattttggctctgga

SEQ ID NO: 199 - DNA, 20 bp, Artificial sequence
  Synthetic oligonucleotide
gttcttggtgctcttggctt

SEQ ID NO: 200 - DNA, 20 bp, Artificial sequence
  Synthetic oligonucleotide
tagttcttggtgctcttggc

SEQ ID NO: 201 - DNA, 20 bp, Artificial sequence
  Synthetic oligonucleotide
aggttgttttctccacactc

SEQ ID NO: 202 - DNA, 20 bp, Artificial sequence
  Synthetic oligonucleotide
acacatactctgtgctgacg

SEQ ID NO: 203 - DNA, 20 bp, Artificial sequence
  Synthetic oligonucleotide
gtggcaaatgtagcattttt

SEQ ID NO: 204 - DNA, 20 bp, Artificial sequence
  Synthetic oligonucleotide
gccacaaatatgttcattct

SEQ ID NO: 205 - DNA, 17 bp, Artificial sequence
  Synthetic oligonucleotide
tcttggtgctcttggct

SEQ ID NO: 206 - DNA, 17 bp, Artificial sequence
  Synthetic oligonucleotide
ccagattattagaccac

SEQ ID NO: 207 - DNA, 17 bp, Artificial sequence
  Synthetic oligonucleotide
gctcatatgatgccttt

SEQ ID NO: 208 - DNA, 17 bp, Artificial sequence
  Synthetic oligonucleotide
gcttgtcaggctgttta

SEQ ID NO: 209 - DNA, 16 bp, Artificial sequence
  Synthetic oligonucleotide
tgtcttgatcaattct

SEQ ID NO: 210 - DNA, 16 bp, Artificial sequence
  Synthetic oligonucleotide
ttgattttggctctgg

SEQ ID NO: 211 - DNA, 16 bp, Artificial sequence
  Synthetic oligonucleotide
actggtttgcagcgat

SEQ ID NO: 212 - DNA, 16 bp, Artificial sequence
  Synthetic oligonucleotide
agattttgctcttggt

SEQ ID NO: 213 - DNA, 16 bp, Artificial sequence
  Synthetic oligonucleotide
cattttgagacttcca

SEQ ID NO: 214 - DNA, 16 bp, Artificial sequence
  Synthetic oligonucleotide
tccattttgagacttc

SEQ ID NO: 215 - DNA, 16 bp, Artificial sequence
  Synthetic oligonucleotide
accagattattagacc

SEQ ID NO: 216 - DNA, 16 bp, Artificial sequence
  Synthetic oligonucleotide
tagacagtgactttaa

SEQ ID NO: 217 - DNA, 16 bp, Artificial sequence
  Synthetic oligonucleotide
tgagaaatgtaaacgg

SEQ ID NO: 218 - DNA, 16 bp, Artificial sequence
  Synthetic oligonucleotide
gctcatatgatgcctt

SEQ ID NO: 219 - DNA, 16 bp, Artificial sequence
  Synthetic oligonucleotide
cttagtagtcatctcc

SEQ ID NO: 220 - DNA, 16 bp, Artificial sequence
  Synthetic oligonucleotide
agagtataaccttcca

SEQ ID NO: 221 - DNA, 16 bp, Artificial sequence
  Synthetic oligonucleotide
cagattattagaccac

SEQ ID NO: 222 - DNA, 16 bp, Artificial sequence
  Synthetic oligonucleotide
tagctcatatgatgcc

SEQ ID NO: 223 - DNA, 16 bp, Artificial sequence
  Synthetic oligonucleotide
ccttttagcagcacta

SEQ ID NO: 224 - DNA, 16 bp, Artificial sequence
  Synthetic oligonucleotide
accttttagcagcact

SEQ ID NO: 225 - DNA, 16 bp, Artificial sequence
  Synthetic oligonucleotide
aaaccttttagcagca

SEQ ID NO: 226 - DNA, 16 bp, Artificial sequence
  Synthetic oligonucleotide
atctgtagatgttggc

SEQ ID NO: 227 - DNA, 16 bp, Artificial sequence
  Synthetic oligonucleotide
taatttgaaccaggct

SEQ ID NO: 228 - DNA, 16 bp, Artificial sequence
  Synthetic oligonucleotide
ttttcttagatggcgt

SEQ ID NO: 229 - DNA, 16 bp, Artificial sequence
  Synthetic oligonucleotide
atctgtataagtccca

SEQ ID NO: 230 - DNA, 16 bp, Artificial sequence
  Synthetic oligonucleotide
aatctgtataagtccc

SEQ ID NO: 231 - DNA, 16 bp, Artificial sequence
  Synthetic oligonucleotide
atgcatgtatcccagt

SEQ ID NO: 232 - DNA, 16 bp, Artificial sequence
  Synthetic oligonucleotide
tagatgcatgtatccc

SEQ ID NO: 233 - DNA, 20 bp, Artificial sequence
  Synthetic oligonucleotide
agtagttcttggtgctcttg

SEQ ID NO: 234 - DNA, 20 bp, Artificial sequence
  Synthetic oligonucleotide
ggttcttgaatactagtcct

SEQ ID NO: 235 - DNA, 20 bp, Artificial sequence
  Synthetic oligonucleotide
aaatttctgtgggttcttga

SEQ ID NO: 236 - DNA, 20 bp, Artificial sequence
  Synthetic oligonucleotide
tggcttggaagatagagaaa

SEQ ID NO: 237 - DNA, 20 bp, Artificial sequence
  Synthetic oligonucleotide
gtattagaatcacagcatat

SEQ ID NO: 238 - DNA, 20 bp, Artificial sequence
  Synthetic oligonucleotide
gattttcaatttcaagcaac

SEQ ID NO: 239 - DNA, 20 bp, Artificial sequence
  Synthetic oligonucleotide
agcttaattgtgaacatttt

SEQ ID NO: 240 - DNA, 20 bp, Artificial sequence
  Synthetic oligonucleotide
gaaggagcttaattgtgaac

SEQ ID NO: 241 - DNA, 20 bp, Artificial sequence
  Synthetic oligonucleotide
caataaaaagaaggagctta

SEQ ID NO: 242 - DNA, 20 bp, Artificial sequence
  Synthetic oligonucleotide
gaacaataaaaagaaggagc

SEQ ID NO: 243 - DNA, 20 bp, Artificial sequence
  Synthetic oligonucleotide
ctggaggaaataactagagg

SEQ ID NO: 244 - DNA, 20 bp, Artificial sequence
  Synthetic oligonucleotide
attctggaggaaataactag

SEQ ID NO: 245 - DNA, 20 bp, Artificial sequence
  Synthetic oligonucleotide
tcaaatgatgaattgtcttg

SEQ ID NO: 246 - DNA, 20 bp, Artificial sequence
  Synthetic oligonucleotide
ttgattttggctctggagat

SEQ ID NO: 247 - DNA, 20 bp, Artificial sequence
  Synthetic oligonucleotide
gcaaatcttgattttggctc

SEQ ID NO: 248 - DNA, 20 bp, Artificial sequence
  Synthetic oligonucleotide
atagcaaatcttgattttgg

SEQ ID NO: 249 - DNA, 20 bp, Artificial sequence
  Synthetic oligonucleotide
cgtctaacatagcaaatctt

SEQ ID NO: 250 - DNA, 20 bp, Artificial sequence
  Synthetic oligonucleotide
tggctaaaatttttacatcg

SEQ ID NO: 251 - DNA, 20 bp, Artificial sequence
  Synthetic oligonucleotide
ccattggctaaaatttttac

SEQ ID NO: 252 - DNA, 20 bp, Artificial sequence
  Synthetic oligonucleotide
aggaggccattggctaaaat

SEQ ID NO: 253 - DNA, 20 bp, Artificial sequence
  Synthetic oligonucleotide
tgaaggaggccattggctaa

SEQ ID NO: 254 - DNA, 20 bp, Artificial sequence
  Synthetic oligonucleotide
gtcccaactgaaggaggcca

SEQ ID NO: 255 - DNA, 20 bp, Artificial sequence
  Synthetic oligonucleotide
ccatgtcccaactgaaggag

SEQ ID NO: 256 - DNA, 20 bp, Artificial sequence
  Synthetic oligonucleotide
agaccatgtcccaactgaag

SEQ ID NO: 257 - DNA, 20 bp, Artificial sequence
  Synthetic oligonucleotide
tttaagaccatgtcccaact

SEQ ID NO: 258 - DNA, 20 bp, Artificial sequence
  Synthetic oligonucleotide
gtctttaagaccatgtccca

SEQ ID NO: 259 - DNA, 20 bp, Artificial sequence
  Synthetic oligonucleotide
ggacaaagtctttaagacca

SEQ ID NO: 260 - DNA, 20 bp, Artificial sequence
  Synthetic oligonucleotide
tcttatggacaaagtcttta

SEQ ID NO: 261 - DNA, 20 bp, Artificial sequence
  Synthetic oligonucleotide
tatgtcattaatttggccct

SEQ ID NO: 262 - DNA, 20 bp, Artificial sequence
  Synthetic oligonucleotide
gatcaaatatgttgagtttt

SEQ ID NO: 263 - DNA, 20 bp, Artificial sequence
  Synthetic oligonucleotide
gactgatcaaatatgttgag

SEQ ID NO: 264 - DNA, 20 bp, Artificial sequence
  Synthetic oligonucleotide
tcttctttgatttcactggt

SEQ ID NO: 265 - DNA, 20 bp, Artificial sequence
  Synthetic oligonucleotide
cttctcagttccttttcttc

SEQ ID NO: 266 - DNA, 20 bp, Artificial sequence
  Synthetic oligonucleotide
gttcttctcagttccttttc

SEQ ID NO: 267 - DNA, 20 bp, Artificial sequence
  Synthetic oligonucleotide
tgtagttcttctcagttcct

SEQ ID NO: 268 - DNA, 20 bp, Artificial sequence
  Synthetic oligonucleotide
tatatgtagttcttctcagt

SEQ ID NO: 269 - DNA, 20 bp, Artificial sequence
  Synthetic oligonucleotide
gtttatatgtagttcttctc

SEQ ID NO: 270 - DNA, 20 bp, Artificial sequence
  Synthetic oligonucleotide
tgtagtttatatgtagttct

SEQ ID NO: 271 - DNA, 20 bp, Artificial sequence
  Synthetic oligonucleotide
gacttgtagtttatatgtag

SEQ ID NO: 272 - DNA, 20 bp, Artificial sequence
  Synthetic oligonucleotide
tcatttttgacttgtagttt

SEQ ID NO: 273 - DNA, 20 bp, Artificial sequence
  Synthetic oligonucleotide
cctcttcatttttgacttgt

SEQ ID NO: 274 - DNA, 20 bp, Artificial sequence
  Synthetic oligonucleotide
tctttacctcttcatttttg

SEQ ID NO: 275 - DNA, 20 bp, Artificial sequence
  Synthetic oligonucleotide
catattctttacctcttcat

SEQ ID NO: 276 - DNA, 20 bp, Artificial sequence
  Synthetic oligonucleotide
gtgacatattctttacctct

SEQ ID NO: 277 - DNA, 20 bp, Artificial sequence
  Synthetic oligonucleotide
gagttcaagtgacatattct

SEQ ID NO: 278 - DNA, 20 bp, Artificial sequence
  Synthetic oligonucleotide
tgagttgagttcaagtgaca

SEQ ID NO: 279 - DNA, 20 bp, Artificial sequence
  Synthetic oligonucleotide
agttttgagttgagttcaag

SEQ ID NO: 280 - DNA, 20 bp, Artificial sequence
  Synthetic oligonucleotide
tcaagttttgagttgagttc

SEQ ID NO: 281 - DNA, 20 bp, Artificial sequence
  Synthetic oligonucleotide
ggaggctttcaagttttgag

SEQ ID NO: 282 - DNA, 20 bp, Artificial sequence
  Synthetic oligonucleotide
tttcttctaggaggctttca

SEQ ID NO: 283 - DNA, 20 bp, Artificial sequence
  Synthetic oligonucleotide
attttttcttctaggaggct

SEQ ID NO: 284 - DNA, 20 bp, Artificial sequence
  Synthetic oligonucleotide
gtagaattttttcttctagg

SEQ ID NO: 285 - DNA, 20 bp, Artificial sequence
  Synthetic oligonucleotide
gctcttctaaatatttcact

SEQ ID NO: 286 - DNA, 20 bp, Artificial sequence
  Synthetic oligonucleotide
agttagttagttgctcttct

SEQ ID NO: 287 - DNA, 20 bp, Artificial sequence
  Synthetic oligonucleotide
caggttgattttgaattaag

SEQ ID NO: 288 - DNA, 20 bp, Artificial sequence
  Synthetic oligonucleotide
tttcaggttgattttgaatt

SEQ ID NO: 289 - DNA, 20 bp, Artificial sequence
  Synthetic oligonucleotide
ggagtttcaggttgattttg

SEQ ID NO: 290 - DNA, 20 bp, Artificial sequence
  Synthetic oligonucleotide
gttctggagtttcaggttga

SEQ ID NO: 291 - DNA, 20 bp, Artificial sequence
  Synthetic oligonucleotide
ttaagtgaagttacttctgg

SEQ ID NO: 292 - DNA, 20 bp, Artificial sequence
  Synthetic oligonucleotide
tgctattatcttgtttttct

SEQ ID NO: 293 - DNA, 20 bp, Artificial sequence
  Synthetic oligonucleotide
ggtctttgatgctattatct

SEQ ID NO: 294 - DNA, 20 bp, Artificial sequence
  Synthetic oligonucleotide
gaaggtctttgatgctatta

SEQ ID NO: 295 - DNA, 20 bp, Artificial sequence
  Synthetic oligonucleotide
ctggagaaggtctttgatgc

SEQ ID NO: 296 - DNA, 20 bp, Artificial sequence
  Synthetic oligonucleotide
ctgagctgattttctatttc

SEQ ID NO: 297 - DNA, 20 bp, Artificial sequence
  Synthetic oligonucleotide
atttctgtgggttcttgaat

SEQ ID NO: 298 - DNA, 20 bp, Artificial sequence
  Synthetic oligonucleotide
gagaaatttctgtgggttct

SEQ ID NO: 299 - DNA, 20 bp, Artificial sequence
  Synthetic oligonucleotide
gatagagaaatttctgtggg

SEQ ID NO: 300 - DNA, 20 bp, Artificial sequence
  Synthetic oligonucleotide
cttggaagatagagaaattt

SEQ ID NO: 301 - DNA, 20 bp, Artificial sequence
  Synthetic oligonucleotide
gtgctcttggcttggaagat

SEQ ID NO: 302 - DNA, 20 bp, Artificial sequence
  Synthetic oligonucleotide
cttggtgctcttggcttgga

SEQ ID NO: 303 - DNA, 20 bp, Artificial sequence
  Synthetic oligonucleotide
gggagtagttcttggtgctc

SEQ ID NO: 304 - DNA, 20 bp, Artificial sequence
  Synthetic oligonucleotide
ctgaagaaagggagtagttc

SEQ ID NO: 305 - DNA, 20 bp, Artificial sequence
  Synthetic oligonucleotide
atcatgttttacatttctta

SEQ ID NO: 306 - DNA, 20 bp, Artificial sequence
  Synthetic oligonucleotide
gccatcatgttttacatttc

SEQ ID NO: 307 - DNA, 20 bp, Artificial sequence
  Synthetic oligonucleotide
gaatgccatcatgttttaca

SEQ ID NO: 308 - DNA, 20 bp, Artificial sequence
  Synthetic oligonucleotide
caggaatgccatcatgtttt

SEQ ID NO: 309 - DNA, 20 bp, Artificial sequence
  Synthetic oligonucleotide
gacttcttaactctatatat

SEQ ID NO: 310 - DNA, 20 bp, Artificial sequence
  Synthetic oligonucleotide
ctagacttcttaactctata

SEQ ID NO: 311 - DNA, 20 bp, Artificial sequence
  Synthetic oligonucleotide
gacctagacttcttaactct

SEQ ID NO: 312 - DNA, 20 bp, Artificial sequence
  Synthetic oligonucleotide
ggaagcagacctagacttct

SEQ ID NO: 313 - DNA, 20 bp, Artificial sequence
  Synthetic oligonucleotide
tctggaagcagacctagact

SEQ ID NO: 314 - DNA, 20 bp, Artificial sequence
  Synthetic oligonucleotide
tcttctggaagcagacctag

SEQ ID NO: 315 - DNA, 20 bp, Artificial sequence
  Synthetic oligonucleotide
ctaatctttagggatttagg

SEQ ID NO: 316 - DNA, 20 bp, Artificial sequence
  Synthetic oligonucleotide
tgtatctaatctttagggat

SEQ ID NO: 317 - DNA, 20 bp, Artificial sequence
  Synthetic oligonucleotide
taacttgggcactatatcct

SEQ ID NO: 318 - DNA, 20 bp, Artificial sequence
  Synthetic oligonucleotide
attgacaaaggtaggtcacc

SEQ ID NO: 319 - DNA, 20 bp, Artificial sequence
  Synthetic oligonucleotide
atatgacatgtatattggat

SEQ ID NO: 320 - DNA, 20 bp, Artificial sequence
  Synthetic oligonucleotide
ttttgtacttttctggaaca

SEQ ID NO: 321 - DNA, 20 bp, Artificial sequence
  Synthetic oligonucleotide
tagtctgtggtcctgaaaat

SEQ ID NO: 322 - DNA, 20 bp, Artificial sequence
  Synthetic oligonucleotide
agcttagtctgtggtcctga

SEQ ID NO: 323 - DNA, 20 bp, Artificial sequence
  Synthetic oligonucleotide
gacagcttagtctgtggtcc

SEQ ID NO: 324 - DNA, 20 bp, Artificial sequence
  Synthetic oligonucleotide
gtattctggccctaaaaaaa

SEQ ID NO: 325 - DNA, 20 bp, Artificial sequence
  Synthetic oligonucleotide
attttggtattctggcccta

SEQ ID NO: 326 - DNA, 20 bp, Artificial sequence
  Synthetic oligonucleotide
tttgcatttgaaattgtcca

SEQ ID NO: 327 - DNA, 20 bp, Artificial sequence
  Synthetic oligonucleotide
ggaagcaactcatatattaa

SEQ ID NO: 328 - DNA, 20 bp, Artificial sequence
  Synthetic oligonucleotide
tatcagaaaaagatacctga

SEQ ID NO: 329 - DNA, 20 bp, Artificial sequence
  Synthetic oligonucleotide
ataatagctaataatgtggg

SEQ ID NO: 330 - DNA, 20 bp, Artificial sequence
  Synthetic oligonucleotide
tgcagataatagctaataat

SEQ ID NO: 331 - DNA, 20 bp, Artificial sequence
  Synthetic oligonucleotide
tgtcattgcagataatagct

SEQ ID NO: 332 - DNA, 20 bp, Artificial sequence
  Synthetic oligonucleotide
taaaagttgtcattgcagat

SEQ ID NO: 333 - DNA, 20 bp, Artificial sequence
  Synthetic oligonucleotide
cggatttttaaaagttgtca

SEQ ID NO: 334 - DNA, 20 bp, Artificial sequence
  Synthetic oligonucleotide
gggattcggatttttaaaag

SEQ ID NO: 335 - DNA, 20 bp, Artificial sequence
  Synthetic oligonucleotide
tttgggattcggatttttaa

SEQ ID NO: 336 - DNA, 20 bp, Artificial sequence
  Synthetic oligonucleotide
acgcttatttgggattcgga

SEQ ID NO: 337 - DNA, 20 bp, Artificial sequence
  Synthetic oligonucleotide
tttaagagatttacaagtca

SEQ ID NO: 338 - DNA, 20 bp, Artificial sequence
  Synthetic oligonucleotide
gactacctgtttttaaaagc

SEQ ID NO: 339 - DNA, 20 bp, Artificial sequence
  Synthetic oligonucleotide
tatggtgactacctgttttt

SEQ ID NO: 340 - DNA, 20 bp, Artificial sequence
  Synthetic oligonucleotide
actttgctgtattataaact

SEQ ID NO: 341 - DNA, 20 bp, Artificial sequence
  Synthetic oligonucleotide
attgtatttaactttgctgt

SEQ ID NO: 342 - DNA, 20 bp, Artificial sequence
  Synthetic oligonucleotide
gagcaactaacttaataggt

SEQ ID NO: 343 - DNA, 20 bp, Artificial sequence
  Synthetic oligonucleotide
gaaatgagcaactaacttaa

SEQ ID NO: 344 - DNA, 20 bp, Artificial sequence
  Synthetic oligonucleotide
aatcaaagaaatgagcaact

SEQ ID NO: 345 - DNA, 20 bp, Artificial sequence
  Synthetic oligonucleotide
accttcttccacattgagtt

SEQ ID NO: 346 - DNA, 20 bp, Artificial sequence
  Synthetic oligonucleotide
cacgaatgtaaccttcttcc

SEQ ID NO: 347 - DNA, 20 bp, Artificial sequence
  Synthetic oligonucleotide
ttaacttgcacgaatgtaac

SEQ ID NO: 348 - DNA, 20 bp, Artificial sequence
  Synthetic oligonucleotide
tatatataccaatatttgcc

SEQ ID NO: 349 - DNA, 20 bp, Artificial sequence
  Synthetic oligonucleotide
tcttaactctatatatacca

SEQ ID NO: 350 - DNA, 20 bp, Artificial sequence
  Synthetic oligonucleotide
ctttaagtgaagttacttct

SEQ ID NO: 351 - DNA, 20 bp, Artificial sequence
  Synthetic oligonucleotide
tctacttactttaagtgaag

SEQ ID NO: 352 - DNA, 20 bp, Artificial sequence
  Synthetic oligonucleotide
gaaccctctttattttctac

SEQ ID NO: 353 - DNA, 20 bp, Artificial sequence
  Synthetic oligonucleotide
acataaacatgaaccctctt

SEQ ID NO: 354 - DNA, 20 bp, Artificial sequence
  Synthetic oligonucleotide
ccacattgaaaacataaaca

SEQ ID NO: 355 - DNA, 20 bp, Artificial sequence
  Synthetic oligonucleotide
gcatgccttagaaatatttt

SEQ ID NO: 356 - DNA, 20 bp, Artificial sequence
  Synthetic oligonucleotide
caatgcaacaaagtatttca

SEQ ID NO: 357 - DNA, 20 bp, Artificial sequence
  Synthetic oligonucleotide
ctggagattatttttcttgg

SEQ ID NO: 358 - DNA, 20 bp, Artificial sequence
  Synthetic oligonucleotide
ttcatatataacattaggga

SEQ ID NO: 359 - DNA, 20 bp, Artificial sequence
  Synthetic oligonucleotide
tcagtgttttcatatataac

SEQ ID NO: 360 - DNA, 20 bp, Artificial sequence
  Synthetic oligonucleotide
gacatagtgttctagattgt

SEQ ID NO: 361 - DNA, 20 bp, Artificial sequence
  Synthetic oligonucleotide
caatagtgtaatgacatagt

SEQ ID NO: 362 - DNA, 20 bp, Artificial sequence
  Synthetic oligonucleotide
ttacttaccttcagtaattt

SEQ ID NO: 363 - DNA, 20 bp, Artificial sequence
  Synthetic oligonucleotide
atcttttccatttactgtat

SEQ ID NO: 364 - DNA, 20 bp, Artificial sequence
  Synthetic oligonucleotide
agaaaaagcccagcatattt

SEQ ID NO: 365 - DNA, 20 bp, Artificial sequence
  Synthetic oligonucleotide
gtatgcttctttcaaatagc

SEQ ID NO: 366 - DNA, 20 bp, Artificial sequence
  Synthetic oligonucleotide
ccttccccttgtatgcttct

SEQ ID NO: 367 - DNA, 20 bp, Artificial sequence
  Synthetic oligonucleotide
cctgtaacactatcataatc

SEQ ID NO: 368 - DNA, 20 bp, Artificial sequence
  Synthetic oligonucleotide
tgacttacctgattttctat

SEQ ID NO: 369 - DNA, 20 bp, Artificial sequence
  Synthetic oligonucleotide
gatgggacataccattaaaa

SEQ ID NO: 370 - DNA, 20 bp, Artificial sequence
  Synthetic oligonucleotide
gtgaaagatgggacatacca

SEQ ID NO: 371 - DNA, 20 bp, Artificial sequence
  Synthetic oligonucleotide
cctgtgtgaaagatgggaca

SEQ ID NO: 372 - DNA, 20 bp, Artificial sequence
  Synthetic oligonucleotide
cattggctgctatgaattaa

SEQ ID NO: 373 - DNA, 20 bp, Artificial sequence
  Synthetic oligonucleotide
gatgacattggctgctatga

SEQ ID NO: 374 - DNA, 20 bp, Artificial sequence
  Synthetic oligonucleotide
gagaaacatgatctaatttg

SEQ ID NO: 375 - DNA, 20 bp, Artificial sequence
  Synthetic oligonucleotide
atggaaagctattgtgtggt

SEQ ID NO: 376 - DNA, 20 bp, Artificial sequence
  Synthetic oligonucleotide
gtctaaagagccaatatgag

SEQ ID NO: 377 - DNA, 20 bp, Artificial sequence
  Synthetic oligonucleotide
aatcttggtctaaagagcca

SEQ ID NO: 378 - DNA, 20 bp, Artificial sequence
  Synthetic oligonucleotide
gagatttacaagtcaaaaat

SEQ ID NO: 379 - DNA, 20 bp, Artificial sequence
  Synthetic oligonucleotide
atttaactttgctgtattat

SEQ ID NO: 380 - DNA, 20 bp, Artificial sequence
  Synthetic oligonucleotide
atcaatgctaaatgaaatca

SEQ ID NO: 381 - DNA, 20 bp, Artificial sequence
  Synthetic oligonucleotide
tattttctggagattatttt

SEQ ID NO: 382 - DNA, 20 bp, Artificial sequence
  Synthetic oligonucleotide
aaaatgaatattggcaattc

SEQ ID NO: 383 - DNA, 20 bp, Artificial sequence
  Synthetic oligonucleotide
aaagtcaatgtgacttagta

SEQ ID NO: 384 - DNA, 20 bp, Artificial sequence
  Synthetic oligonucleotide
aaggtatagtgatacctcat

SEQ ID NO: 385 - DNA, 20 bp, Artificial sequence
  Synthetic oligonucleotide
cagcaggaatgccatcatgt

SEQ ID NO: 386 - DNA, 20 bp, Artificial sequence
  Synthetic oligonucleotide
tgatggcatacatgccactt

SEQ ID NO: 387 - DNA, 20 bp, Artificial sequence
  Synthetic oligonucleotide
tgctgggtctgatggcatac

SEQ ID NO: 388 - DNA, 20 bp, Artificial sequence
  Synthetic oligonucleotide
gagttgctgggtctgatggc

SEQ ID NO: 389 - DNA, 20 bp, Artificial sequence
  Synthetic oligonucleotide
aaaacttgagagttgctggg

SEQ ID NO: 390 - DNA, 20 bp, Artificial sequence
  Synthetic oligonucleotide
gacatgaaaaacttgagagt

SEQ ID NO: 391 - DNA, 20 bp, Artificial sequence
  Synthetic oligonucleotide
acatcacagtagacatgaaa

SEQ ID NO: 392 - DNA, 20 bp, Artificial sequence
  Synthetic oligonucleotide
agttttgtgatccatctatt

SEQ ID NO: 393 - DNA, 20 bp, Artificial sequence
  Synthetic oligonucleotide
tgaagttttgtgatccatct

SEQ ID NO: 394 - DNA, 20 bp, Artificial sequence
  Synthetic oligonucleotide
cgtttcattgaagttttgtg

SEQ ID NO: 395 - DNA, 20 bp, Artificial sequence
  Synthetic oligonucleotide
ccatatttgtagttctccca

SEQ ID NO: 396 - DNA, 20 bp, Artificial sequence
  Synthetic oligonucleotide
aaaccatatttgtagttctc

SEQ ID NO: 397 - DNA, 20 bp, Artificial sequence
  Synthetic oligonucleotide
aattctccatcaagcctccc

SEQ ID NO: 398 - DNA, 20 bp, Artificial sequence
  Synthetic oligonucleotide
atcttctctaggcccaacca

SEQ ID NO: 399 - DNA, 20 bp, Artificial sequence
  Synthetic oligonucleotide
gagtatatcttctctaggcc

SEQ ID NO: 400 - DNA, 20 bp, Artificial sequence
  Synthetic oligonucleotide
ctatggagtatatcttctct

SEQ ID NO: 401 - DNA, 20 bp, Artificial sequence
  Synthetic oligonucleotide
gcttcactatggagtatatc

SEQ ID NO: 402 - DNA, 20 bp, Artificial sequence
  Synthetic oligonucleotide
agattgcttcactatggagt

SEQ ID NO: 403 - DNA, 20 bp, Artificial sequence
  Synthetic oligonucleotide
ccagtcttccaactcaattc

SEQ ID NO: 404 - DNA, 20 bp, Artificial sequence
  Synthetic oligonucleotide
gtctttccagtcttccaact

SEQ ID NO: 405 - DNA, 20 bp, Artificial sequence
  Synthetic oligonucleotide
gtttgttgtctttccagtct

SEQ ID NO: 406 - DNA, 20 bp, Artificial sequence
  Synthetic oligonucleotide
aatgtttgttgtctttccag

SEQ ID NO: 407 - DNA, 20 bp, Artificial sequence
  Synthetic oligonucleotide
cgtgatttcccaagtaaaaa

SEQ ID NO: 408 - DNA, 20 bp, Artificial sequence
  Synthetic oligonucleotide
gttttccgggattgcattgg

SEQ ID NO: 409 - DNA, 20 bp, Artificial sequence
  Synthetic oligonucleotide
tctttgttttccgggattgc

SEQ ID NO: 410 - DNA, 20 bp, Artificial sequence
  Synthetic oligonucleotide
ccaaatctttgttttccggg

SEQ ID NO: 411 - DNA, 20 bp, Artificial sequence
  Synthetic oligonucleotide
acaccaaatctttgttttcc

SEQ ID NO: 412 - DNA, 20 bp, Artificial sequence
  Synthetic oligonucleotide
agaaaacaccaaatctttgt

SEQ ID NO: 413 - DNA, 20 bp, Artificial sequence
  Synthetic oligonucleotide
caagtagaaaacaccaaatc

SEQ ID NO: 414 - DNA, 20 bp, Artificial sequence
  Synthetic oligonucleotide
gatcccaagtagaaaacacc

SEQ ID NO: 415 - DNA, 20 bp, Artificial sequence
  Synthetic oligonucleotide
tttgctttgtgatcccaagt

SEQ ID NO: 416 - DNA, 20 bp, Artificial sequence
  Synthetic oligonucleotide
tccttttgctttgtgatccc

SEQ ID NO: 417 - DNA, 20 bp, Artificial sequence
  Synthetic oligonucleotide
gaagtgtccttttgctttgt

SEQ ID NO: 418 - DNA, 20 bp, Artificial sequence
  Synthetic oligonucleotide
tgccaccaccagcctcctga

SEQ ID NO: 419 - DNA, 20 bp, Artificial sequence
  Synthetic oligonucleotide
ctcatcatgccaccaccagc

SEQ ID NO: 420 - DNA, 20 bp, Artificial sequence
  Synthetic oligonucleotide
ccatttaggttgttttctcc

SEQ ID NO: 421 - DNA, 20 bp, Artificial sequence
  Synthetic oligonucleotide
atatttaccatttaggttgt

SEQ ID NO: 422 - DNA, 20 bp, Artificial sequence
  Synthetic oligonucleotide
cttggtttgttatatttacc

SEQ ID NO: 423 - DNA, 20 bp, Artificial sequence
  Synthetic oligonucleotide
atagagtataaccttccatt

SEQ ID NO: 424 - DNA, 20 bp, Artificial sequence
  Synthetic oligonucleotide
ttttatagagtataaccttc

SEQ ID NO: 425 - DNA, 20 bp, Artificial sequence
  Synthetic oligonucleotide
tggttgattttatagagtat

SEQ ID NO: 426 - DNA, 20 bp, Artificial sequence
  Synthetic oligonucleotide
attttggttgattttataga

SEQ ID NO: 427 - DNA, 20 bp, Artificial sequence
  Synthetic oligonucleotide
tcaacattttggttgatttt

SEQ ID NO: 428 - DNA, 20 bp, Artificial sequence
  Synthetic oligonucleotide
ggatggatcaacattttggt

SEQ ID NO: 429 - DNA, 20 bp, Artificial sequence
  Synthetic oligonucleotide
gttggatggatcaacatttt

SEQ ID NO: 430 - DNA, 20 bp, Artificial sequence
  Synthetic oligonucleotide
tctgttggatggatcaacat

SEQ ID NO: 431 - DNA, 20 bp, Artificial sequence
  Synthetic oligonucleotide
ctgaatctgttggatggatc

SEQ ID NO: 432 - DNA, 20 bp, Artificial sequence
  Synthetic oligonucleotide
agctttctgaatctgttgga

SEQ ID NO: 433 - DNA, 20 bp, Artificial sequence
  Synthetic oligonucleotide
cattcaaagctttctgaatc

SEQ ID NO: 434 - DNA, 20 bp, Artificial sequence
  Synthetic oligonucleotide
gttcattcaaagctttctga

SEQ ID NO: 435 - DNA, 20 bp, Artificial sequence
  Synthetic oligonucleotide
tcagttcattcaaagctttc

SEQ ID NO: 436 - DNA, 20 bp, Artificial sequence
  Synthetic oligonucleotide
gcctcagttcattcaaagct

SEQ ID NO: 437 - DNA, 20 bp, Artificial sequence
  Synthetic oligonucleotide
atttgcctcagttcattcaa

SEQ ID NO: 438 - DNA, 20 bp, Artificial sequence
  Synthetic oligonucleotide
ttaaatttgcctcagttcat

SEQ ID NO: 439 - DNA, 20 bp, Artificial sequence
  Synthetic oligonucleotide
gccttttaaatttgcctcag

SEQ ID NO: 440 - DNA, 20 bp, Artificial sequence
  Synthetic oligonucleotide
aggatttaataccagattat

SEQ ID NO: 441 - DNA, 20 bp, Artificial sequence
  Synthetic oligonucleotide
cttaaggatttaataccaga

SEQ ID NO: 442 - DNA, 20 bp, Artificial sequence
  Synthetic oligonucleotide
tctcttaaggatttaatacc

SEQ ID NO: 443 - DNA, 20 bp, Artificial sequence
  Synthetic oligonucleotide
gacagtgactttaagataaa

SEQ ID NO: 444 - DNA, 20 bp, Artificial sequence
  Synthetic oligonucleotide
tgtgattgtatgtttaatct

SEQ ID NO: 445 - DNA, 20 bp, Artificial sequence
  Synthetic oligonucleotide
aggttatgtgattgtatgtt

SEQ ID NO: 446 - DNA, 20 bp, Artificial sequence
  Synthetic oligonucleotide
ctttaaggttatgtgattgt

SEQ ID NO: 447 - DNA, 20 bp, Artificial sequence
  Synthetic oligonucleotide
ggtattctttaaggttatgt

SEQ ID NO: 448 - DNA, 20 bp, Artificial sequence
  Synthetic oligonucleotide
attgattcccacatcacaaa

SEQ ID NO: 449 - DNA, 20 bp, Artificial sequence
  Synthetic oligonucleotide
ctaaaattgattcccacatc

SEQ ID NO: 450 - DNA, 20 bp, Artificial sequence
  Synthetic oligonucleotide
ccatctaaaattgattccca

SEQ ID NO: 451 - DNA, 20 bp, Artificial sequence
  Synthetic oligonucleotide
ttgtgatattagctcatatg

SEQ ID NO: 452 - DNA, 20 bp, Artificial sequence
  Synthetic oligonucleotide
actagttttttaaactggga

SEQ ID NO: 453 - DNA, 20 bp, Artificial sequence
  Synthetic oligonucleotide
gtcaagtttagagttttaac

SEQ ID NO: 454 - DNA, 20 bp, Artificial sequence
  Synthetic oligonucleotide
tatttagtcaagtttagagt

SEQ ID NO: 455 - DNA, 20 bp, Artificial sequence
  Synthetic oligonucleotide
gatttttacacatactctgt

SEQ ID NO: 456 - DNA, 20 bp, Artificial sequence
  Synthetic oligonucleotide
ctgcttcattaggtttcata

SEQ ID NO: 457 - DNA, 20 bp, Artificial sequence
  Synthetic oligonucleotide
cagcaggaatgccatcatgt

SEQ ID NO: 458 - DNA, 20 bp, Artificial sequence
  Synthetic oligonucleotide
tgatggcatacatgccactt

SEQ ID NO: 459 - DNA, 20 bp, Artificial sequence
  Synthetic oligonucleotide
tgctgggtctgatggcatac

SEQ ID NO: 460 - DNA, 20 bp, Artificial sequence
  Synthetic oligonucleotide
gagttgctgggtctgatggc

SEQ ID NO: 461 - DNA, 20 bp, Artificial sequence
  Synthetic oligonucleotide
aaaacttgagagttgctggg

SEQ ID NO: 462 - DNA, 20 bp, Artificial sequence
  Synthetic oligonucleotide
gacatgaaaaacttgagagt

SEQ ID NO: 463 - DNA, 20 bp, Artificial sequence
  Synthetic oligonucleotide
acatcacagtagacatgaaa

SEQ ID NO: 464 - DNA, 20 bp, Artificial sequence
  Synthetic oligonucleotide
agttttgtgatccatctatt

SEQ ID NO: 465 - DNA, 20 bp, Artificial sequence
  Synthetic oligonucleotide
tgaagttttgtgatccatct

SEQ ID NO: 466 - DNA, 20 bp, Artificial sequence
  Synthetic oligonucleotide
cgtttcattgaagttttgtg

SEQ ID NO: 467 - DNA, 20 bp, Artificial sequence
  Synthetic oligonucleotide
ccatatttgtagttctccca

SEQ ID NO: 468 - DNA, 20 bp, Artificial sequence
  Synthetic oligonucleotide
aaaccatatttgtagttctc

SEQ ID NO: 469 - DNA, 20 bp, Artificial sequence
  Synthetic oligonucleotide
aattctccatcaagcctccc

SEQ ID NO: 470 - DNA, 20 bp, Artificial sequence
  Synthetic oligonucleotide
atcttctctaggcccaacca

SEQ ID NO: 471 - DNA, 20 bp, Artificial sequence
  Synthetic oligonucleotide
gagtatatcttctctaggcc

SEQ ID NO: 472 - DNA, 20 bp, Artificial sequence
  Synthetic oligonucleotide
ctatggagtatatcttctct

SEQ ID NO: 473 - DNA, 20 bp, Artificial sequence
  Synthetic oligonucleotide
gcttcactatggagtatatc

SEQ ID NO: 474 - DNA, 20 bp, Artificial sequence
  Synthetic oligonucleotide
agattgcttcactatggagt

SEQ ID NO: 475 - DNA, 20 bp, Artificial sequence
  Synthetic oligonucleotide
ccagtcttccaactcaattc

SEQ ID NO: 476 - DNA, 20 bp, Artificial sequence
  Synthetic oligonucleotide
gtctttccagtcttccaact

SEQ ID NO: 477 - DNA, 20 bp, Artificial sequence
  Synthetic oligonucleotide
gtttgttgtctttccagtct

SEQ ID NO: 478 - DNA, 20 bp, Artificial sequence
  Synthetic oligonucleotide
aatgtttgttgtctttccag

SEQ ID NO: 479 - DNA, 20 bp, Artificial sequence
  Synthetic oligonucleotide
cgtgatttcccaagtaaaaa

SEQ ID NO: 480 - DNA, 20 bp, Artificial sequence
  Synthetic oligonucleotide
gttttccgggattgcattgg

SEQ ID NO: 481 - DNA, 20 bp, Artificial sequence
  Synthetic oligonucleotide
tctttgttttccgggattgc

SEQ ID NO: 482 - DNA, 20 bp, Artificial sequence
  Synthetic oligonucleotide
ccaaatctttgttttccggg

SEQ ID NO: 483 - DNA, 20 bp, Artificial sequence
  Synthetic oligonucleotide
acaccaaatctttgttttcc

SEQ ID NO: 484 - DNA, 20 bp, Artificial sequence
  Synthetic oligonucleotide
agaaaacaccaaatctttgt

SEQ ID NO: 485 - DNA, 20 bp, Artificial sequence
  Synthetic oligonucleotide
caagtagaaaacaccaaatc

SEQ ID NO: 486 - DNA, 20 bp, Artificial sequence
  Synthetic oligonucleotide
gatcccaagtagaaaacacc

SEQ ID NO: 487 - DNA, 20 bp, Artificial sequence
  Synthetic oligonucleotide
tttgctttgtgatcccaagt

SEQ ID NO: 488 - DNA, 20 bp, Artificial sequence
  Synthetic oligonucleotide
tccttttgctttgtgatccc

SEQ ID NO: 489 - DNA, 20 bp, Artificial sequence
  Synthetic oligonucleotide
gaagtgtccttttgctttgt

SEQ ID NO: 490 - DNA, 20 bp, Artificial sequence
  Synthetic oligonucleotide
tgccaccaccagcctcctga

SEQ ID NO: 491 - DNA, 20 bp, Artificial sequence
  Synthetic oligonucleotide
ctcatcatgccaccaccagc

SEQ ID NO: 492 - DNA, 20 bp, Artificial sequence
  Synthetic oligonucleotide
ccatttaggttgttttctcc

SEQ ID NO: 493 - DNA, 20 bp, Artificial sequence
  Synthetic oligonucleotide
atatttaccatttaggttgt

SEQ ID NO: 494 - DNA, 20 bp, Artificial sequence
  Synthetic oligonucleotide
cttggtttgttatatttacc

SEQ ID NO: 495 - DNA, 20 bp, Artificial sequence
  Synthetic oligonucleotide
atagagtataaccttccatt

SEQ ID NO: 496 - DNA, 20 bp, Artificial sequence
  Synthetic oligonucleotide
ttttatagagtataaccttc

SEQ ID NO: 497 - DNA, 20 bp, Artificial sequence
  Synthetic oligonucleotide
tggttgattttatagagtat

SEQ ID NO: 498 - DNA, 20 bp, Artificial sequence
  Synthetic oligonucleotide
attttggttgattttataga

SEQ ID NO: 499 - DNA, 20 bp, Artificial sequence
  Synthetic oligonucleotide
tcaacattttggttgatttt

SEQ ID NO: 500 - DNA, 20 bp, Artificial sequence
  Synthetic oligonucleotide
ggatggatcaacattttggt

SEQ ID NO: 501 - DNA, 20 bp, Artificial sequence
  Synthetic oligonucleotide
gttggatggatcaacatttt

SEQ ID NO: 502 - DNA, 20 bp, Artificial sequence
  Synthetic oligonucleotide
tctgttggatggatcaacat

SEQ ID NO: 503 - DNA, 20 bp, Artificial sequence
  Synthetic oligonucleotide
ctgaatctgttggatggatc

SEQ ID NO: 504 - DNA, 20 bp, Artificial sequence
  Synthetic oligonucleotide
agctttctgaatctgttgga

SEQ ID NO: 505 - DNA, 20 bp, Artificial sequence
  Synthetic oligonucleotide
cattcaaagctttctgaatc

SEQ ID NO: 506 - DNA, 20 bp, Artificial sequence
  Synthetic oligonucleotide
gttcattcaaagctttctga

SEQ ID NO: 507 - DNA, 20 bp, Artificial sequence
  Synthetic oligonucleotide
tcagttcattcaaagctttc

SEQ ID NO: 508 - DNA, 20 bp, Artificial sequence
  Synthetic oligonucleotide
gcctcagttcattcaaagct

SEQ ID NO: 509 - DNA, 20 bp, Artificial sequence
  Synthetic oligonucleotide
atttgcctcagttcattcaa

SEQ ID NO: 510 - DNA, 20 bp, Artificial sequence
  Synthetic oligonucleotide
ttaaatttgcctcagttcat

SEQ ID NO: 511 - DNA, 20 bp, Artificial sequence
  Synthetic oligonucleotide
gccttttaaatttgcctcag

SEQ ID NO: 512 - DNA, 20 bp, Artificial sequence
  Synthetic oligonucleotide
aggatttaataccagattat

SEQ ID NO: 513 - DNA, 20 bp, Artificial sequence
  Synthetic oligonucleotide
cttaaggatttaataccaga

SEQ ID NO: 514 - DNA, 20 bp, Artificial sequence
  Synthetic oligonucleotide
tctcttaaggatttaatacc

SEQ ID NO: 515 - DNA, 20 bp, Artificial sequence
  Synthetic oligonucleotide
gacagtgactttaagataaa

SEQ ID NO: 516 - DNA, 20 bp, Artificial sequence
  Synthetic oligonucleotide
tgtgattgtatgtttaatct

SEQ ID NO: 517 - DNA, 20 bp, Artificial sequence
  Synthetic oligonucleotide
aggttatgtgattgtatgtt

SEQ ID NO: 518 - DNA, 20 bp, Artificial sequence
  Synthetic oligonucleotide
ctttaaggttatgtgattgt

SEQ ID NO: 519 - DNA, 20 bp, Artificial sequence
  Synthetic oligonucleotide
ggtattctttaaggttatgt

SEQ ID NO: 520 - DNA, 20 bp, Artificial sequence
  Synthetic oligonucleotide
attgattcccacatcacaaa

SEQ ID NO: 521 - DNA, 20 bp, Artificial sequence
  Synthetic oligonucleotide
ctaaaattgattcccacatc

SEQ ID NO: 522 - DNA, 20 bp, Artificial sequence
  Synthetic oligonucleotide
ccatctaaaattgattccca

SEQ ID NO: 523 - DNA, 20 bp, Artificial sequence
  Synthetic oligonucleotide
ttgtgatattagctcatatg

SEQ ID NO: 524 - DNA, 20 bp, Artificial sequence
  Synthetic oligonucleotide
actagttttttaaactggga

SEQ ID NO: 525 - DNA, 20 bp, Artificial sequence
  Synthetic oligonucleotide
gtcaagtttagagttttaac

SEQ ID NO: 526 - DNA, 20 bp, Artificial sequence
  Synthetic oligonucleotide
tatttagtcaagtttagagt

SEQ ID NO: 527 - DNA, 20 bp, Artificial sequence
  Synthetic oligonucleotide
gatttttacacatactctgt

SEQ ID NO: 528 - DNA, 20 bp, Artificial sequence
  Synthetic oligonucleotide
ctgcttcattaggtttcata

SEQ ID NO: 529 - DNA, 20 bp, Artificial sequence
  Synthetic oligonucleotide
cagcaggaatgccatcatgt

SEQ ID NO: 530 - DNA, 20 bp, Artificial sequence
  Synthetic oligonucleotide
tgatggcatacatgccactt

SEQ ID NO: 531 - DNA, 20 bp, Artificial sequence
  Synthetic oligonucleotide
tgctgggtctgatggcatac

SEQ ID NO: 532 - DNA, 20 bp, Artificial sequence
  Synthetic oligonucleotide
gagttgctgggtctgatggc

SEQ ID NO: 533 - DNA, 20 bp, Artificial sequence
  Synthetic oligonucleotide
aaaacttgagagttgctggg

SEQ ID NO: 534 - DNA, 20 bp, Artificial sequence
  Synthetic oligonucleotide
gacatgaaaaacttgagagt

SEQ ID NO: 535 - DNA, 20 bp, Artificial sequence
  Synthetic oligonucleotide
acatcacagtagacatgaaa

SEQ ID NO: 536 - DNA, 20 bp, Artificial sequence
  Synthetic oligonucleotide
agttttgtgatccatctatt

SEQ ID NO: 537 - DNA, 20 bp, Artificial sequence
  Synthetic oligonucleotide
tgaagttttgtgatccatct

SEQ ID NO: 538 - DNA, 20 bp, Artificial sequence
  Synthetic oligonucleotide
cgtttcattgaagttttgtg

SEQ ID NO: 539 - DNA, 20 bp, Artificial sequence
  Synthetic oligonucleotide
ccatatttgtagttctccca

SEQ ID NO: 540 - DNA, 20 bp, Artificial sequence
  Synthetic oligonucleotide
aaaccatatttgtagttctc

SEQ ID NO: 541 - DNA, 20 bp, Artificial sequence
  Synthetic oligonucleotide
aattctccatcaagcctccc

SEQ ID NO: 542 - DNA, 20 bp, Artificial sequence
  Synthetic oligonucleotide
atcttctctaggcccaacca

SEQ ID NO: 543 - DNA, 20 bp, Artificial sequence
  Synthetic oligonucleotide
gagtatatcttctctaggcc

SEQ ID NO: 544 - DNA, 20 bp, Artificial sequence
  Synthetic oligonucleotide
ctatggagtatatcttctct

SEQ ID NO: 545 - DNA, 20 bp, Artificial sequence
  Synthetic oligonucleotide
gcttcactatggagtatatc

SEQ ID NO: 546 - DNA, 20 bp, Artificial sequence
  Synthetic oligonucleotide
agattgcttcactatggagt

SEQ ID NO: 547 - DNA, 20 bp, Artificial sequence
  Synthetic oligonucleotide
ccagtcttccaactcaattc

SEQ ID NO: 548 - DNA, 20 bp, Artificial sequence
  Synthetic oligonucleotide
gtctttccagtcttccaact

SEQ ID NO: 549 - DNA, 20 bp, Artificial sequence
  Synthetic oligonucleotide
gtttgttgtctttccagtct

SEQ ID NO: 550 - DNA, 20 bp, Artificial sequence
  Synthetic oligonucleotide
aatgtttgttgtctttccag

SEQ ID NO: 551 - DNA, 20 bp, Artificial sequence
  Synthetic oligonucleotide
cgtgatttcccaagtaaaaa

SEQ ID NO: 552 - DNA, 20 bp, Artificial sequence
  Synthetic oligonucleotide
gttttccgggattgcattgg

SEQ ID NO: 553 - DNA, 20 bp, Artificial sequence
  Synthetic oligonucleotide
tctttgttttccgggattgc

SEQ ID NO: 554 - DNA, 20 bp, Artificial sequence
  Synthetic oligonucleotide
ccaaatctttgttttccggg

SEQ ID NO: 555 - DNA, 20 bp, Artificial sequence
  Synthetic oligonucleotide
acaccaaatctttgttttcc

SEQ ID NO: 556 - DNA, 20 bp, Artificial sequence
  Synthetic oligonucleotide
agaaaacaccaaatctttgt

SEQ ID NO: 557 - DNA, 20 bp, Artificial sequence
  Synthetic oligonucleotide
caagtagaaaacaccaaatc

SEQ ID NO: 558 - DNA, 20 bp, Artificial sequence
  Synthetic oligonucleotide
gatcccaagtagaaaacacc

SEQ ID NO: 559 - DNA, 20 bp, Artificial sequence
  Synthetic oligonucleotide
tttgctttgtgatcccaagt

SEQ ID NO: 560 - DNA, 20 bp, Artificial sequence
  Synthetic oligonucleotide
tccttttgctttgtgatccc

SEQ ID NO: 561 - DNA, 20 bp, Artificial sequence
  Synthetic oligonucleotide
gaagtgtccttttgctttgt

SEQ ID NO: 562 - DNA, 20 bp, Artificial sequence
  Synthetic oligonucleotide
tgccaccaccagcctcctga

SEQ ID NO: 563 - DNA, 20 bp, Artificial sequence
  Synthetic oligonucleotide
ctcatcatgccaccaccagc

SEQ ID NO: 564 - DNA, 20 bp, Artificial sequence
  Synthetic oligonucleotide
ccatttaggttgttttctcc

SEQ ID NO: 565 - DNA, 20 bp, Artificial sequence
  Synthetic oligonucleotide
atatttaccatttaggttgt

SEQ ID NO: 566 - DNA, 20 bp, Artificial sequence
  Synthetic oligonucleotide
cttggtttgttatatttacc

SEQ ID NO: 567 - DNA, 20 bp, Artificial sequence
  Synthetic oligonucleotide
atagagtataaccttccatt

SEQ ID NO: 568 - DNA, 20 bp, Artificial sequence
  Synthetic oligonucleotide
ttttatagagtataaccttc

SEQ ID NO: 569 - DNA, 20 bp, Artificial sequence
  Synthetic oligonucleotide
tggttgattttatagagtat

SEQ ID NO: 570 - DNA, 20 bp, Artificial sequence
  Synthetic oligonucleotide
attttggttgattttataga

SEQ ID NO: 571 - DNA, 20 bp, Artificial sequence
  Synthetic oligonucleotide
tcaacattttggttgatttt

SEQ ID NO: 572 - DNA, 20 bp, Artificial sequence
  Synthetic oligonucleotide
ggatggatcaacattttggt

SEQ ID NO: 573 - DNA, 20 bp, Artificial sequence
  Synthetic oligonucleotide
gttggatggatcaacatttt

SEQ ID NO: 574 - DNA, 20 bp, Artificial sequence
  Synthetic oligonucleotide
tctgttggatggatcaacat

SEQ ID NO: 575 - DNA, 20 bp, Artificial sequence
  Synthetic oligonucleotide
ctgaatctgttggatggatc

SEQ ID NO: 576 - DNA, 20 bp, Artificial sequence
  Synthetic oligonucleotide
agctttctgaatctgttgga

SEQ ID NO: 577 - DNA, 20 bp, Artificial sequence
  Synthetic oligonucleotide
cattcaaagctttctgaatc

SEQ ID NO: 578 - DNA, 20 bp, Artificial sequence
  Synthetic oligonucleotide
gttcattcaaagctttctga

SEQ ID NO: 579 - DNA, 20 bp, Artificial sequence
  Synthetic oligonucleotide
tcagttcattcaaagctttc

SEQ ID NO: 580 - DNA, 20 bp, Artificial sequence
  Synthetic oligonucleotide
gcctcagttcattcaaagct

SEQ ID NO: 581 - DNA, 20 bp, Artificial sequence
  Synthetic oligonucleotide
atttgcctcagttcattcaa

SEQ ID NO: 582 - DNA, 20 bp, Artificial sequence
  Synthetic oligonucleotide
ttaaatttgcctcagttcat

SEQ ID NO: 583 - DNA, 20 bp, Artificial sequence
  Synthetic oligonucleotide
gccttttaaatttgcctcag

SEQ ID NO: 584 - DNA, 20 bp, Artificial sequence
  Synthetic oligonucleotide
aggatttaataccagattat

SEQ ID NO: 585 - DNA, 20 bp, Artificial sequence
  Synthetic oligonucleotide
cttaaggatttaataccaga

SEQ ID NO: 586 - DNA, 20 bp, Artificial sequence
  Synthetic oligonucleotide
tctcttaaggatttaatacc

SEQ ID NO: 587 - DNA, 20 bp, Artificial sequence
  Synthetic oligonucleotide
gacagtgactttaagataaa

SEQ ID NO: 588 - DNA, 20 bp, Artificial sequence
  Synthetic oligonucleotide
tgtgattgtatgtttaatct

SEQ ID NO: 589 - DNA, 20 bp, Artificial sequence
  Synthetic oligonucleotide
aggttatgtgattgtatgtt

SEQ ID NO: 590 - DNA, 20 bp, Artificial sequence
  Synthetic oligonucleotide
ctttaaggttatgtgattgt

SEQ ID NO: 591 - DNA, 20 bp, Artificial sequence
  Synthetic oligonucleotide
ggtattctttaaggttatgt

SEQ ID NO: 592 - DNA, 20 bp, Artificial sequence
  Synthetic oligonucleotide
attgattcccacatcacaaa

SEQ ID NO: 593 - DNA, 20 bp, Artificial sequence
  Synthetic oligonucleotide
ctaaaattgattcccacatc

SEQ ID NO: 594 - DNA, 20 bp, Artificial sequence
  Synthetic oligonucleotide
ccatctaaaattgattccca

SEQ ID NO: 595 - DNA, 20 bp, Artificial sequence
  Synthetic oligonucleotide
ttgtgatattagctcatatg

SEQ ID NO: 596 - DNA, 20 bp, Artificial sequence
  Synthetic oligonucleotide
actagttttttaaactggga

SEQ ID NO: 597 - DNA, 20 bp, Artificial sequence
  Synthetic oligonucleotide
gtcaagtttagagttttaac

SEQ ID NO: 598 - DNA, 20 bp, Artificial sequence
  Synthetic oligonucleotide
tatttagtcaagtttagagt

SEQ ID NO: 599 - DNA, 20 bp, Artificial sequence
  Synthetic oligonucleotide
gatttttacacatactctgt

SEQ ID NO: 600 - DNA, 20 bp, Artificial sequence
  Synthetic oligonucleotide
ctgcttcattaggtttcata

SEQ ID NO: 601 - DNA, 20 bp, Artificial sequence
  Synthetic oligonucleotide
cagtgttattcagattgtac

SEQ ID NO: 602 - DNA, 20 bp, Artificial sequence
  Synthetic oligonucleotide
agtgtcttaccatcatgttt

SEQ ID NO: 603 - DNA, 20 bp, Artificial sequence
  Synthetic oligonucleotide
caccagcctcctaaaggaga

SEQ ID NO: 604 - DNA, 20 bp, Artificial sequence
  Synthetic oligonucleotide
gaggaggtgaagtcagtgag

SEQ ID NO: 605 - DNA, 20 bp, Artificial sequence
  Synthetic oligonucleotide
tagagtagaggaggtgaagt

SEQ ID NO: 606 - DNA, 20 bp, Artificial sequence
  Synthetic oligonucleotide
tgtttgatgtgtttgaatac

SEQ ID NO: 607 - DNA, 20 bp, Artificial sequence
  Synthetic oligonucleotide
gaaacaacaagggcaaaggc

SEQ ID NO: 608 - DNA, 20 bp, Artificial sequence
  Synthetic oligonucleotide
tgtttgataacgaccctaag

SEQ ID NO: 609 - DNA, 20 bp, Artificial sequence
  Synthetic oligonucleotide
tttttggttaagtgaccttg

SEQ ID NO: 610 - DNA, 20 bp, Artificial sequence
  Synthetic oligonucleotide
gtagaagttttcagggatgg

SEQ ID NO: 611 - DNA, 20 bp, Artificial sequence
  Synthetic oligonucleotide
aggaagtagaagttttcagg

SEQ ID NO: 612 - DNA, 20 bp, Artificial sequence
  Synthetic oligonucleotide
aggtgagtgtgcaggagaaa

SEQ ID NO: 613 - DNA, 20 bp, Artificial sequence
  Synthetic oligonucleotide
ttaaataaaggtgagtgtgc

SEQ ID NO: 614 - DNA, 20 bp, Artificial sequence
  Synthetic oligonucleotide
agtgcaggaatagaagagat

SEQ ID NO: 615 - DNA, 20 bp, Artificial sequence
  Synthetic oligonucleotide
cattttagtgcaggaataga

SEQ ID NO: 616 - DNA, 20 bp, Artificial sequence
  Synthetic oligonucleotide
ctatattctggagtatatac

SEQ ID NO: 617 - DNA, 20 bp, Artificial sequence
  Synthetic oligonucleotide
cagtattctatattctggag

SEQ ID NO: 618 - DNA, 20 bp, Artificial sequence
  Synthetic oligonucleotide
gtgccatacagtattctata

SEQ ID NO: 619 - DNA, 20 bp, Artificial sequence
  Synthetic oligonucleotide
ctgtgtgaatatgacattac

SEQ ID NO: 620 - DNA, 20 bp, Artificial sequence
  Synthetic oligonucleotide
tgaggcacactatttctagt

SEQ ID NO: 621 - DNA, 20 bp, Artificial sequence
  Synthetic oligonucleotide
gacctttaattatgaggcac

SEQ ID NO: 622 - DNA, 20 bp, Artificial sequence
  Synthetic oligonucleotide
gaatgttgacctttaattat

SEQ ID NO: 623 - DNA, 20 bp, Artificial sequence
  Synthetic oligonucleotide
ttgttgaatgttgaccttta

SEQ ID NO: 624 - DNA, 20 bp, Artificial sequence
  Synthetic oligonucleotide
tctactaagtaactatgtga

SEQ ID NO: 625 - DNA, 20 bp, Artificial sequence
  Synthetic oligonucleotide
ctcttttctactaagtaact

SEQ ID NO: 626 - DNA, 20 bp, Artificial sequence
  Synthetic oligonucleotide
aaggatctattgtaaagttt

SEQ ID NO: 627 - DNA, 20 bp, Artificial sequence
  Synthetic oligonucleotide
ctaggaccttatttaaaagg

SEQ ID NO: 628 - DNA, 20 bp, Artificial sequence
  Synthetic oligonucleotide
atttcctaggaccttattta

SEQ ID NO: 629 - DNA, 20 bp, Artificial sequence
  Synthetic oligonucleotide
ttgacagtaagaaaagcaga

SEQ ID NO: 630 - DNA, 20 bp, Artificial sequence
  Synthetic oligonucleotide
ttctcattgacagtaagaaa

SEQ ID NO: 631 - DNA, 20 bp, Artificial sequence
  Synthetic oligonucleotide
agtttttctcattgacagta

SEQ ID NO: 632 - DNA, 20 bp, Artificial sequence
  Synthetic oligonucleotide
attgaatgatagtttttctc

SEQ ID NO: 633 - DNA, 20 bp, Artificial sequence
  Synthetic oligonucleotide
ttgggtttgcaatttattga

SEQ ID NO: 634 - DNA, 20 bp, Artificial sequence
  Synthetic oligonucleotide
agtgtgttgggtttgcaatt

SEQ ID NO: 635 - DNA, 20 bp, Artificial sequence
  Synthetic oligonucleotide
tatttaagtgtgttgggttt

SEQ ID NO: 636 - DNA, 20 bp, Artificial sequence
  Synthetic oligonucleotide
atatattcagtagtttatcg

SEQ ID NO: 637 - DNA, 20 bp, Artificial sequence
  Synthetic oligonucleotide
agatgttggcaggttggcaa

SEQ ID NO: 638 - DNA, 20 bp, Artificial sequence
  Synthetic oligonucleotide
tctgtagatgttggcaggtt

SEQ ID NO: 639 - DNA, 20 bp, Artificial sequence
  Synthetic oligonucleotide
ttgataatttttgacctgta

SEQ ID NO: 640 - DNA, 20 bp, Artificial sequence
  Synthetic oligonucleotide
ggctttcttgataatttgat

SEQ ID NO: 641 - DNA, 20 bp, Artificial sequence
  Synthetic oligonucleotide
gtcttactgatcttcagacc

SEQ ID NO: 642 - DNA, 20 bp, Artificial sequence
  Synthetic oligonucleotide
tttaggtcttactgatcttc

SEQ ID NO: 643 - DNA, 20 bp, Artificial sequence
  Synthetic oligonucleotide
tcagttttaggtcttactga

SEQ ID NO: 644 - DNA, 20 bp, Artificial sequence
  Synthetic oligonucleotide
tgatattctgttcagatttt

SEQ ID NO: 645 - DNA, 20 bp, Artificial sequence
  Synthetic oligonucleotide
tagagactgctttgcttaga

SEQ ID NO: 646 - DNA, 20 bp, Artificial sequence
  Synthetic oligonucleotide
aggccaaaagtagagactgc

SEQ ID NO: 647 - DNA, 20 bp, Artificial sequence
  Synthetic oligonucleotide
ggcaaaaaagcagacattgg

SEQ ID NO: 648 - DNA, 20 bp, Artificial sequence
  Synthetic oligonucleotide
aatcagggacattatttaat

SEQ ID NO: 649 - DNA, 20 bp, Artificial sequence
  Synthetic oligonucleotide
tatttaatcagggacattat

SEQ ID NO: 650 - DNA, 20 bp, Artificial sequence
  Synthetic oligonucleotide
ctcaaaatatttaatcaggg

SEQ ID NO: 651 - DNA, 20 bp, Artificial sequence
  Synthetic oligonucleotide
tacctgttctcaaaatattt

SEQ ID NO: 652 - DNA, 20 bp, Artificial sequence
  Synthetic oligonucleotide
gtacagattacctgttctca

SEQ ID NO: 653 - DNA, 20 bp, Artificial sequence
  Synthetic oligonucleotide
ggtgtttgatatttagataa

SEQ ID NO: 654 - DNA, 20 bp, Artificial sequence
  Synthetic oligonucleotide
ttgtctttcagttcataatg

SEQ ID NO: 655 - DNA, 20 bp, Artificial sequence
  Synthetic oligonucleotide
acagtttgtctttcagttca

SEQ ID NO: 656 - DNA, 20 bp, Artificial sequence
  Synthetic oligonucleotide
tctgagctgataaaagaata

SEQ ID NO: 657 - DNA, 20 bp, Artificial sequence
  Synthetic oligonucleotide
cccaccaaagtgtcttacca

SEQ ID NO: 658 - DNA, 20 bp, Artificial sequence
  Synthetic oligonucleotide
cttcaagaaggaaacccacc

SEQ ID NO: 659 - DNA, 20 bp, Artificial sequence
  Synthetic oligonucleotide
aatagcttcaagaaggaaac

SEQ ID NO: 660 - DNA, 20 bp, Artificial sequence
  Synthetic oligonucleotide
acaagtcctaagaataggga

SEQ ID NO: 661 - DNA, 20 bp, Artificial sequence
  Synthetic oligonucleotide
gtctagaacaagtcctaaga

SEQ ID NO: 662 - DNA, 20 bp, Artificial sequence
  Synthetic oligonucleotide
tctaataatcaagtccatat

SEQ ID NO: 663 - DNA, 20 bp, Artificial sequence
  Synthetic oligonucleotide
accttctatattatctaata

SEQ ID NO: 664 - DNA, 20 bp, Artificial sequence
  Synthetic oligonucleotide
gcatgtatctcttaaacagg

SEQ ID NO: 665 - DNA, 20 bp, Artificial sequence
  Synthetic oligonucleotide
gtccagtgacctttaactcc

SEQ ID NO: 666 - DNA, 20 bp, Artificial sequence
  Synthetic oligonucleotide
tcttaccaaactattttctt

SEQ ID NO: 667 - DNA, 20 bp, Artificial sequence
  Synthetic oligonucleotide
gtaatgtttatgttaaagca

SEQ ID NO: 668 - DNA, 20 bp, Artificial sequence
  Synthetic oligonucleotide
ttgtggcaaatgtagcattt

SEQ ID NO: 669 - DNA, 20 bp, Artificial sequence
  Synthetic oligonucleotide
gagatttcacttgacatttt

SEQ ID NO: 670 - DNA, 20 bp, Artificial sequence
  Synthetic oligonucleotide
ggagcttgagatttcacttg

SEQ ID NO: 671 - DNA, 20 bp, Artificial sequence
  Synthetic oligonucleotide
catcagatttagtaatagga

SEQ ID NO: 672 - DNA, 20 bp, Artificial sequence
  Synthetic oligonucleotide
gttattacatcagatttagt

SEQ ID NO: 673 - DNA, 20 bp, Artificial sequence
  Synthetic oligonucleotide
cagcaggaatgcctagaatc

SEQ ID NO: 674 - DNA, 20 bp, Artificial sequence
  Synthetic oligonucleotide
ctccttagacaggttttacc

SEQ ID NO: 675 - DNA, 20 bp, Artificial sequence
  Synthetic oligonucleotide
gtctattctccttagacagg

SEQ ID NO: 676 - DNA, 20 bp, Artificial sequence
  Synthetic oligonucleotide
atgaatgattgaatgtagtc

SEQ ID NO: 677 - DNA, 20 bp, Artificial sequence
  Synthetic oligonucleotide
atatgaaggctgagactgct

SEQ ID NO: 678 - DNA, 20 bp, Artificial sequence
  Synthetic oligonucleotide
ataaattatatgaaggctga

SEQ ID NO: 679 - DNA, 20 bp, Artificial sequence
  Synthetic oligonucleotide
atatttaagaacagacatgt

SEQ ID NO: 680 - DNA, 20 bp, Artificial sequence
  Synthetic oligonucleotide
atttgtaacagttactactt

SEQ ID NO: 681 - DNA, 20 bp, Artificial sequence
  Synthetic oligonucleotide
cacagcttatttgtaacagt

SEQ ID NO: 682 - DNA, 20 bp, Artificial sequence
  Synthetic oligonucleotide
gtgactaatgctaggagtgg

SEQ ID NO: 683 - DNA, 20 bp, Artificial sequence
  Synthetic oligonucleotide
gaatagagtgactaatgcta

SEQ ID NO: 684 - DNA, 20 bp, Artificial sequence
  Synthetic oligonucleotide
atgagagaatagagtgacta

SEQ ID NO: 685 - DNA, 20 bp, Artificial sequence
  Synthetic oligonucleotide
tatactgtatgtctgagttt

SEQ ID NO: 686 - DNA, 20 bp, Artificial sequence
  Synthetic oligonucleotide
aactaattcattataagcca

SEQ ID NO: 687 - DNA, 20 bp, Artificial sequence
  Synthetic oligonucleotide
tttggattttaaacatctgt

SEQ ID NO: 688 - DNA, 20 bp, Artificial sequence
  Synthetic oligonucleotide
tgtatgtgctttttggattt

SEQ ID NO: 689 - DNA, 20 bp, Artificial sequence
  Synthetic oligonucleotide
catggatttttgtatgtgct

SEQ ID NO: 690 - DNA, 20 bp, Artificial sequence
  Synthetic oligonucleotide
tcattcatggatttttgtat

SEQ ID NO: 691 - DNA, 20 bp, Artificial sequence
  Synthetic oligonucleotide
acttagacatcattcatgga

SEQ ID NO: 692 - DNA, 20 bp, Artificial sequence
  Synthetic oligonucleotide
gtgagtacttagacatcatt

SEQ ID NO: 693 - DNA, 20 bp, Artificial sequence
  Synthetic oligonucleotide
tttataagtgagtacttaga

SEQ ID NO: 694 - DNA, 20 bp, Artificial sequence
  Synthetic oligonucleotide
gtcttctactttataagtga

SEQ ID NO: 695 - DNA, 20 bp, Artificial sequence
  Synthetic oligonucleotide
atgaatgtcttctactttat

SEQ ID NO: 696 - DNA, 20 bp, Artificial sequence
  Synthetic oligonucleotide
caaatagtactgagcattta

SEQ ID NO: 697 - DNA, 20 bp, Artificial sequence
  Synthetic oligonucleotide
ttagaagatttggagctaca

SEQ ID NO: 698 - DNA, 20 bp, Artificial sequence
  Synthetic oligonucleotide
tcactattagaagatttgga

SEQ ID NO: 699 - DNA, 20 bp, Artificial sequence
  Synthetic oligonucleotide
gggttacactcactattaga

SEQ ID NO: 700 - DNA, 20 bp, Artificial sequence
  Synthetic oligonucleotide
acttacctgtcagcctttta

SEQ ID NO: 701 - DNA, 20 bp, Artificial sequence
  Synthetic oligonucleotide
cttaccagaattaagtgagt

SEQ ID NO: 702 - DNA, 20 bp, Artificial sequence
  Synthetic oligonucleotide
aatacaagtacaaatgggtt

SEQ ID NO: 703 - DNA, 20 bp, Artificial sequence
  Synthetic oligonucleotide
ctggtaaatacaagtacaaa

SEQ ID NO: 704 - DNA, 20 bp, Artificial sequence
  Synthetic oligonucleotide
ggattgctggtaaatacaag

SEQ ID NO: 705 - DNA, 20 bp, Artificial sequence
  Synthetic oligonucleotide
tcattttaaggattgctggt

SEQ ID NO: 706 - DNA, 20 bp, Artificial sequence
  Synthetic oligonucleotide
agttagtaggaagcttcatt

SEQ ID NO: 707 - DNA, 20 bp, Artificial sequence
  Synthetic oligonucleotide
gctattgagttagtaggaag

SEQ ID NO: 708 - DNA, 20 bp, Artificial sequence
  Synthetic oligonucleotide
agcatggttcttaataactt

SEQ ID NO: 709 - DNA, 20 bp, Artificial sequence
  Synthetic oligonucleotide
ctttgtagaaaaagacagga

SEQ ID NO: 710 - DNA, 20 bp, Artificial sequence
  Synthetic oligonucleotide
acctggcctttggtatttgc

SEQ ID NO: 711 - DNA, 20 bp, Artificial sequence
  Synthetic oligonucleotide
agtctttatatggataaact

SEQ ID NO: 712 - DNA, 20 bp, Artificial sequence
  Synthetic oligonucleotide
cgtcattggtagaggaatat

SEQ ID NO: 713 - DNA, 20 bp, Artificial sequence
  Synthetic oligonucleotide
gattatcctttctataatgc

SEQ ID NO: 714 - DNA, 20 bp, Artificial sequence
  Synthetic oligonucleotide
gtcttgaatcccttgatcat

SEQ ID NO: 715 - DNA, 20 bp, Artificial sequence
  Synthetic oligonucleotide
ggtgcaactaattgagttgt

SEQ ID NO: 716 - DNA, 20 bp, Artificial sequence
  Synthetic oligonucleotide
gtgttttttattggtgcaac

SEQ ID NO: 717 - DNA, 20 bp, Artificial sequence
  Synthetic oligonucleotide
attctcctgaaaagaaaagt

SEQ ID NO: 718 - DNA, 20 bp, Artificial sequence
  Synthetic oligonucleotide
atgccaccaccagcctccta

SEQ ID NO: 719 - DNA, 20 bp, Artificial sequence
  Synthetic oligonucleotide
atatcctttaacaaatgggt

SEQ ID NO: 720 - DNA, 20 bp, Artificial sequence
  Synthetic oligonucleotide
gcactatatcctttaacaaa

SEQ ID NO: 721 - DNA, 20 bp, Artificial sequence
  Synthetic oligonucleotide
acttgggcactatatccttt

SEQ ID NO: 722 - DNA, 20 bp, Artificial sequence
  Synthetic oligonucleotide
gaaacatgtcctatgagagt

SEQ ID NO: 723 - DNA, 20 bp, Artificial sequence
  Synthetic oligonucleotide
ttgagcactttaagcaaagt

SEQ ID NO: 724 - DNA, 20 bp, Artificial sequence
  Synthetic oligonucleotide
ggaatttgagcactttaagc

SEQ ID NO: 725 - DNA, 20 bp, Artificial sequence
  Synthetic oligonucleotide
tagattagacaactgtgagt

SEQ ID NO: 726 - DNA, 20 bp, Artificial sequence
  Synthetic oligonucleotide
aaaatgaaggtcaagtttga

SEQ ID NO: 727 - DNA, 20 bp, Artificial sequence
  Synthetic oligonucleotide
gtgaaagcaaaatgaaggtc

SEQ ID NO: 728 - DNA, 20 bp, Artificial sequence
  Synthetic oligonucleotide
gtattgtgaaagcaaaatga

SEQ ID NO: 729 - DNA, 20 bp, Artificial sequence
  Synthetic oligonucleotide
tggagagtatagtattgtga

SEQ ID NO: 730 - DNA, 20 bp, Artificial sequence
  Synthetic oligonucleotide
aggaatagaagagataaata

SEQ ID NO: 731 - DNA, 20 bp, Artificial sequence
  Synthetic oligonucleotide
tggagtatatacaaataatg

SEQ ID NO: 732 - DNA, 20 bp, Artificial sequence
  Synthetic oligonucleotide
tgtttacattgtagattaat

SEQ ID NO: 733 - DNA, 20 bp, Artificial sequence
  Synthetic oligonucleotide
cagaatatataatatcttgc

SEQ ID NO: 734 - DNA, 20 bp, Artificial sequence
  Synthetic oligonucleotide
tgcaatttattgaatgatag

SEQ ID NO: 735 - DNA, 20 bp, Artificial sequence
  Synthetic oligonucleotide
cataatacataatttgaacc

SEQ ID NO: 736 - DNA, 20 bp, Artificial sequence
  Synthetic oligonucleotide
ataattttcagttttaggtc

SEQ ID NO: 737 - DNA, 20 bp, Artificial sequence
  Synthetic oligonucleotide
tttcagtaatgtttatgtta

SEQ ID NO: 738 - DNA, 20 bp, Artificial sequence
  Synthetic oligonucleotide
aatgcctagaatcaataaaa

SEQ ID NO: 739 - DNA, 20 bp, Artificial sequence
  Synthetic oligonucleotide
gtaaatatttgtagattagc

SEQ ID NO: 740 - DNA, 20 bp, Artificial sequence
  Synthetic oligonucleotide
acaaatgtgtaattgtttga

SEQ ID NO: 741 - DNA, 20 bp, Artificial sequence
  Synthetic oligonucleotide
tactaacaaatgtgtaattg

SEQ ID NO: 742 - DNA, 20 bp, Artificial sequence
  Synthetic oligonucleotide
tgataagtatatttaagaac

SEQ ID NO: 743 - DNA, 20 bp, Artificial sequence
  Synthetic oligonucleotide
ttaacttccaattaattgat

SEQ ID NO: 744 - DNA, 20 bp, Artificial sequence
  Synthetic oligonucleotide
tctgttattttatcttgctt

SEQ ID NO: 745 - DNA, 20 bp, Artificial sequence
  Synthetic oligonucleotide
atcacaatcctttttattaa

SEQ ID NO: 746 - DNA, 20 bp, Artificial sequence
  Synthetic oligonucleotide
agagacttgagtaataataa

SEQ ID NO: 747 - DNA, 20 bp, Artificial sequence
  Synthetic oligonucleotide
aacaaaatgaaacatgtcct

SEQ ID NO: 748 - DNA, 20 bp, Artificial sequence
  Synthetic oligonucleotide
cagcaggaatgccatcatgt

SEQ ID NO: 749 - DNA, 20 bp, Artificial sequence
  Synthetic oligonucleotide
tgatggcatacatgccactt

SEQ ID NO: 750 - DNA, 20 bp, Artificial sequence
  Synthetic oligonucleotide
tgctgggtctgatggcatac

SEQ ID NO: 751 - DNA, 20 bp, Artificial sequence
  Synthetic oligonucleotide
gagttgctgggtctgatggc

SEQ ID NO: 752 - DNA, 20 bp, Artificial sequence
  Synthetic oligonucleotide
aaaacttgagagttgctggg

SEQ ID NO: 753 - DNA, 20 bp, Artificial sequence
  Synthetic oligonucleotide
gacatgaaaaacttgagagt

SEQ ID NO: 754 - DNA, 20 bp, Artificial sequence
  Synthetic oligonucleotide
acatcacagtagacatgaaa

SEQ ID NO: 755 - DNA, 20 bp, Artificial sequence
  Synthetic oligonucleotide
agttttgtgatccatctatt

SEQ ID NO: 756 - DNA, 20 bp, Artificial sequence
  Synthetic oligonucleotide
tgaagttttgtgatccatct

SEQ ID NO: 757 - DNA, 20 bp, Artificial sequence
  Synthetic oligonucleotide
cgtttcattgaagttttgtg

SEQ ID NO: 758 - DNA, 20 bp, Artificial sequence
  Synthetic oligonucleotide
ccatatttgtagttctccca

SEQ ID NO: 759 - DNA, 20 bp, Artificial sequence
  Synthetic oligonucleotide
aaaccatatttgtagttctc

SEQ ID NO: 760 - DNA, 20 bp, Artificial sequence
  Synthetic oligonucleotide
aattctccatcaagcctccc

SEQ ID NO: 761 - DNA, 20 bp, Artificial sequence
  Synthetic oligonucleotide
atcttctctaggcccaacca

SEQ ID NO: 762 - DNA, 20 bp, Artificial sequence
  Synthetic oligonucleotide
gagtatatcttctctaggcc

SEQ ID NO: 763 - DNA, 20 bp, Artificial sequence
  Synthetic oligonucleotide
ctatggagtatatcttctct

SEQ ID NO: 764 - DNA, 20 bp, Artificial sequence
  Synthetic oligonucleotide
gcttcactatggagtatatc

SEQ ID NO: 765 - DNA, 20 bp, Artificial sequence
  Synthetic oligonucleotide
agattgcttcactatggagt

SEQ ID NO: 766 - DNA, 20 bp, Artificial sequence
  Synthetic oligonucleotide
ccagtcttccaactcaattc

SEQ ID NO: 767 - DNA, 20 bp, Artificial sequence
  Synthetic oligonucleotide
gtctttccagtcttccaact

SEQ ID NO: 768 - DNA, 20 bp, Artificial sequence
  Synthetic oligonucleotide
gtttgttgtctttccagtct

SEQ ID NO: 769 - DNA, 20 bp, Artificial sequence
  Synthetic oligonucleotide
aatgtttgttgtctttccag

SEQ ID NO: 770 - DNA, 20 bp, Artificial sequence
  Synthetic oligonucleotide
cgtgatttcccaagtaaaaa

SEQ ID NO: 771 - DNA, 20 bp, Artificial sequence
  Synthetic oligonucleotide
gttttccgggattgcattgg

SEQ ID NO: 772 - DNA, 20 bp, Artificial sequence
  Synthetic oligonucleotide
tctttgttttccgggattgc

SEQ ID NO: 773 - DNA, 20 bp, Artificial sequence
  Synthetic oligonucleotide
ccaaatctttgttttccggg

SEQ ID NO: 774 - DNA, 20 bp, Artificial sequence
  Synthetic oligonucleotide
acaccaaatctttgttttcc

SEQ ID NO: 775 - DNA, 20 bp, Artificial sequence
  Synthetic oligonucleotide
agaaaacaccaaatctttgt

SEQ ID NO: 776 - DNA, 20 bp, Artificial sequence
  Synthetic oligonucleotide
caagtagaaaacaccaaatc

SEQ ID NO: 777 - DNA, 20 bp, Artificial sequence
  Synthetic oligonucleotide
gatcccaagtagaaaacacc

SEQ ID NO: 778 - DNA, 20 bp, Artificial sequence
  Synthetic oligonucleotide
tttgctttgtgatcccaagt

SEQ ID NO: 779 - DNA, 20 bp, Artificial sequence
  Synthetic oligonucleotide
tccttttgctttgtgatccc

SEQ ID NO: 780 - DNA, 20 bp, Artificial sequence
  Synthetic oligonucleotide
gaagtgtccttttgctttgt

SEQ ID NO: 781 - DNA, 20 bp, Artificial sequence
  Synthetic oligonucleotide
tgccaccaccagcctcctga

SEQ ID NO: 782 - DNA, 20 bp, Artificial sequence
  Synthetic oligonucleotide
ctcatcatgccaccaccagc

SEQ ID NO: 783 - DNA, 20 bp, Artificial sequence
  Synthetic oligonucleotide
ccatttaggttgttttctcc

SEQ ID NO: 784 - DNA, 20 bp, Artificial sequence
  Synthetic oligonucleotide
atatttaccatttaggttgt

SEQ ID NO: 785 - DNA, 20 bp, Artificial sequence
  Synthetic oligonucleotide
cttggtttgttatatttacc

SEQ ID NO: 786 - DNA, 20 bp, Artificial sequence
  Synthetic oligonucleotide
atagagtataaccttccatt

SEQ ID NO: 787 - DNA, 20 bp, Artificial sequence
  Synthetic oligonucleotide
ttttatagagtataaccttc

SEQ ID NO: 788 - DNA, 20 bp, Artificial sequence
  Synthetic oligonucleotide
tggttgattttatagagtat

SEQ ID NO: 789 - DNA, 20 bp, Artificial sequence
  Synthetic oligonucleotide
attttggttgattttataga

SEQ ID NO: 790 - DNA, 20 bp, Artificial sequence
  Synthetic oligonucleotide
tcaacattttggttgatttt

SEQ ID NO: 791 - DNA, 20 bp, Artificial sequence
  Synthetic oligonucleotide
ggatggatcaacattttggt

SEQ ID NO: 792 - DNA, 20 bp, Artificial sequence
  Synthetic oligonucleotide
gttggatggatcaacatttt

SEQ ID NO: 793 - DNA, 20 bp, Artificial sequence
  Synthetic oligonucleotide
tctgttggatggatcaacat

SEQ ID NO: 794 - DNA, 20 bp, Artificial sequence
  Synthetic oligonucleotide
ctgaatctgttggatggatc

SEQ ID NO: 795 - DNA, 20 bp, Artificial sequence
  Synthetic oligonucleotide
agctttctgaatctgttgga

SEQ ID NO: 796 - DNA, 20 bp, Artificial sequence
  Synthetic oligonucleotide
cattcaaagctttctgaatc

SEQ ID NO: 797 - DNA, 20 bp, Artificial sequence
  Synthetic oligonucleotide
gttcattcaaagctttctga

SEQ ID NO: 798 - DNA, 20 bp, Artificial sequence
  Synthetic oligonucleotide
tcagttcattcaaagctttc

SEQ ID NO: 799 - DNA, 20 bp, Artificial sequence
  Synthetic oligonucleotide
gcctcagttcattcaaagct

SEQ ID NO: 800 - DNA, 20 bp, Artificial sequence
  Synthetic oligonucleotide
atttgcctcagttcattcaa

SEQ ID NO: 801 - DNA, 20 bp, Artificial sequence
  Synthetic oligonucleotide
ttaaatttgcctcagttcat

SEQ ID NO: 802 - DNA, 20 bp, Artificial sequence
  Synthetic oligonucleotide
gccttttaaatttgcctcag

SEQ ID NO: 803 - DNA, 20 bp, Artificial sequence
  Synthetic oligonucleotide
aggatttaataccagattat

SEQ ID NO: 804 - DNA, 20 bp, Artificial sequence
  Synthetic oligonucleotide
cttaaggatttaataccaga

SEQ ID NO: 805 - DNA, 20 bp, Artificial sequence
  Synthetic oligonucleotide
tctcttaaggatttaatacc

SEQ ID NO: 806 - DNA, 20 bp, Artificial sequence
  Synthetic oligonucleotide
gacagtgactttaagataaa

SEQ ID NO: 807 - DNA, 20 bp, Artificial sequence
  Synthetic oligonucleotide
tgtgattgtatgtttaatct

SEQ ID NO: 808 - DNA, 20 bp, Artificial sequence
  Synthetic oligonucleotide
aggttatgtgattgtatgtt

SEQ ID NO: 809 - DNA, 20 bp, Artificial sequence
  Synthetic oligonucleotide
ctttaaggttatgtgattgt

SEQ ID NO: 810 - DNA, 20 bp, Artificial sequence
  Synthetic oligonucleotide
ggtattctttaaggttatgt

SEQ ID NO: 811 - DNA, 20 bp, Artificial sequence
  Synthetic oligonucleotide
attgattcccacatcacaaa

SEQ ID NO: 812 - DNA, 20 bp, Artificial sequence
  Synthetic oligonucleotide
ctaaaattgattcccacatc

SEQ ID NO: 813 - DNA, 20 bp, Artificial sequence
  Synthetic oligonucleotide
ccatctaaaattgattccca

SEQ ID NO: 814 - DNA, 20 bp, Artificial sequence
  Synthetic oligonucleotide
ttgtgatattagctcatatg

SEQ ID NO: 815 - DNA, 20 bp, Artificial sequence
  Synthetic oligonucleotide
actagttttttaaactggga

SEQ ID NO: 816 - DNA, 20 bp, Artificial sequence
  Synthetic oligonucleotide
gtcaagtttagagttttaac

SEQ ID NO: 817 - DNA, 20 bp, Artificial sequence
  Synthetic oligonucleotide
tatttagtcaagtttagagt

SEQ ID NO: 818 - DNA, 20 bp, Artificial sequence
  Synthetic oligonucleotide
gatttttacacatactctgt

SEQ ID NO: 819 - DNA, 20 bp, Artificial sequence
  Synthetic oligonucleotide
ctgcttcattaggtttcata

SEQ ID NO: 820 - DNA, 20 bp, Artificial sequence
  Synthetic oligonucleotide
caccagcctcctaaaggaga

SEQ ID NO: 821 - DNA, 20 bp, Artificial sequence
  Synthetic oligonucleotide
gacttcttaactctatatat

SEQ ID NO: 822 - DNA, 20 bp, Artificial sequence
  Synthetic oligonucleotide
ctagacttcttaactctata

SEQ ID NO: 823 - DNA, 20 bp, Artificial sequence
  Synthetic oligonucleotide
gacctagacttcttaactct

SEQ ID NO: 824 - DNA, 20 bp, Artificial sequence
  Synthetic oligonucleotide
ggaagcagacctagacttct

SEQ ID NO: 825 - DNA, 20 bp, Artificial sequence
  Synthetic oligonucleotide
tctggaagcagacctagact

SEQ ID NO: 826 - DNA, 20 bp, Artificial sequence
  Synthetic oligonucleotide
tcttctggaagcagacctag

SEQ ID NO: 827 - DNA, 20 bp, Artificial sequence
  Synthetic oligonucleotide
ctaatctttagggatttagg

SEQ ID NO: 828 - DNA, 20 bp, Artificial sequence
  Synthetic oligonucleotide
tgtatctaatctttagggat

SEQ ID NO: 829 - DNA, 20 bp, Artificial sequence
  Synthetic oligonucleotide
taacttgggcactatatcct

SEQ ID NO: 830 - DNA, 20 bp, Artificial sequence
  Synthetic oligonucleotide
attgacaaaggtaggtcacc

SEQ ID NO: 831 - DNA, 20 bp, Artificial sequence
  Synthetic oligonucleotide
atatgacatgtatattggat

SEQ ID NO: 832 - DNA, 20 bp, Artificial sequence
  Synthetic oligonucleotide
ttttgtacttttctggaaca

SEQ ID NO: 833 - DNA, 20 bp, Artificial sequence
  Synthetic oligonucleotide
tagtctgtggtcctgaaaat

SEQ ID NO: 834 - DNA, 20 bp, Artificial sequence
  Synthetic oligonucleotide
agcttagtctgtggtcctga

SEQ ID NO: 835 - DNA, 20 bp, Artificial sequence
  Synthetic oligonucleotide
gacagcttagtctgtggtcc

SEQ ID NO: 836 - DNA, 20 bp, Artificial sequence
  Synthetic oligonucleotide
gtattctggccctaaaaaaa

SEQ ID NO: 837 - DNA, 20 bp, Artificial sequence
  Synthetic oligonucleotide
attttggtattctggcccta

SEQ ID NO: 838 - DNA, 20 bp, Artificial sequence
  Synthetic oligonucleotide
gaaattgtccaatttttggg

SEQ ID NO: 839 - DNA, 20 bp, Artificial sequence
  Synthetic oligonucleotide
tttgcatttgaaattgtcca

SEQ ID NO: 840 - DNA, 20 bp, Artificial sequence
  Synthetic oligonucleotide
ggaagcaactcatatattaa

SEQ ID NO: 841 - DNA, 20 bp, Artificial sequence
  Synthetic oligonucleotide
tatcagaaaaagatacctga

SEQ ID NO: 842 - DNA, 20 bp, Artificial sequence
  Synthetic oligonucleotide
ataatagctaataatgtggg

SEQ ID NO: 843 - DNA, 20 bp, Artificial sequence
  Synthetic oligonucleotide
tgcagataatagctaataat

SEQ ID NO: 844 - DNA, 20 bp, Artificial sequence
  Synthetic oligonucleotide
tgtcattgcagataatagct

SEQ ID NO: 845 - DNA, 20 bp, Artificial sequence
  Synthetic oligonucleotide
taaaagttgtcattgcagat

SEQ ID NO: 846 - DNA, 20 bp, Artificial sequence
  Synthetic oligonucleotide
cggatttttaaaagttgtca

SEQ ID NO: 847 - DNA, 20 bp, Artificial sequence
  Synthetic oligonucleotide
gggattcggatttttaaaag

SEQ ID NO: 848 - DNA, 20 bp, Artificial sequence
  Synthetic oligonucleotide
tttgggattcggatttttaa

SEQ ID NO: 849 - DNA, 20 bp, Artificial sequence
  Synthetic oligonucleotide
acgcttatttgggattcgga

SEQ ID NO: 850 - DNA, 20 bp, Artificial sequence
  Synthetic oligonucleotide
tttaagagatttacaagtca

SEQ ID NO: 851 - DNA, 20 bp, Artificial sequence
  Synthetic oligonucleotide
gactacctgtttttaaaagc

SEQ ID NO: 852 - DNA, 20 bp, Artificial sequence
  Synthetic oligonucleotide
tatggtgactacctgttttt

SEQ ID NO: 853 - DNA, 20 bp, Artificial sequence
  Synthetic oligonucleotide
actttgctgtattataaact

SEQ ID NO: 854 - DNA, 20 bp, Artificial sequence
  Synthetic oligonucleotide
attgtatttaactttgctgt

SEQ ID NO: 855 - DNA, 20 bp, Artificial sequence
  Synthetic oligonucleotide
gagcaactaacttaataggt

SEQ ID NO: 856 - DNA, 20 bp, Artificial sequence
  Synthetic oligonucleotide
gaaatgagcaactaacttaa

SEQ ID NO: 857 - DNA, 20 bp, Artificial sequence
  Synthetic oligonucleotide
aatcaaagaaatgagcaact

SEQ ID NO: 858 - DNA, 20 bp, Artificial sequence
  Synthetic oligonucleotide
accttcttccacattgagtt

SEQ ID NO: 859 - DNA, 20 bp, Artificial sequence
  Synthetic oligonucleotide
cacgaatgtaaccttcttcc

SEQ ID NO: 860 - DNA, 20 bp, Artificial sequence
  Synthetic oligonucleotide
ttaacttgcacgaatgtaac

SEQ ID NO: 861 - DNA, 20 bp, Artificial sequence
  Synthetic oligonucleotide
tatatataccaatatttgcc

SEQ ID NO: 862 - DNA, 20 bp, Artificial sequence
  Synthetic oligonucleotide
tcttaactctatatatacca

SEQ ID NO: 863 - DNA, 20 bp, Artificial sequence
  Synthetic oligonucleotide
ctttaagtgaagttacttct

SEQ ID NO: 864 - DNA, 20 bp, Artificial sequence
  Synthetic oligonucleotide
tctacttactttaagtgaag

SEQ ID NO: 865 - DNA, 20 bp, Artificial sequence
  Synthetic oligonucleotide
gaaccctctttattttctac

SEQ ID NO: 866 - DNA, 20 bp, Artificial sequence
  Synthetic oligonucleotide
acataaacatgaaccctctt

SEQ ID NO: 867 - DNA, 20 bp, Artificial sequence
  Synthetic oligonucleotide
ccacattgaaaacataaaca

SEQ ID NO: 868 - DNA, 20 bp, Artificial sequence
  Synthetic oligonucleotide
gcatgccttagaaatatttt

SEQ ID NO: 869 - DNA, 20 bp, Artificial sequence
  Synthetic oligonucleotide
caatgcaacaaagtatttca

SEQ ID NO: 870 - DNA, 20 bp, Artificial sequence
  Synthetic oligonucleotide
ctggagattatttttcttgg

SEQ ID NO: 871 - DNA, 20 bp, Artificial sequence
  Synthetic oligonucleotide
ttcatatataacattaggga

SEQ ID NO: 872 - DNA, 20 bp, Artificial sequence
  Synthetic oligonucleotide
tcagtgttttcatatataac

SEQ ID NO: 873 - DNA, 20 bp, Artificial sequence
  Synthetic oligonucleotide
gacatagtgttctagattgt

SEQ ID NO: 874 - DNA, 20 bp, Artificial sequence
  Synthetic oligonucleotide
caatagtgtaatgacatagt

SEQ ID NO: 875 - DNA, 20 bp, Artificial sequence
  Synthetic oligonucleotide
ttacttaccttcagtaattt

SEQ ID NO: 876 - DNA, 20 bp, Artificial sequence
  Synthetic oligonucleotide
atcttttccatttactgtat

SEQ ID NO: 877 - DNA, 20 bp, Artificial sequence
  Synthetic oligonucleotide
agaaaaagcccagcatattt

SEQ ID NO: 878 - DNA, 20 bp, Artificial sequence
  Synthetic oligonucleotide
gtatgcttctttcaaatagc

SEQ ID NO: 879 - DNA, 20 bp, Artificial sequence
  Synthetic oligonucleotide
ccttccccttgtatgcttct

SEQ ID NO: 880 - DNA, 20 bp, Artificial sequence
  Synthetic oligonucleotide
cctgtaacactatcataatc

SEQ ID NO: 881 - DNA, 20 bp, Artificial sequence
  Synthetic oligonucleotide
tgacttacctgattttctat

SEQ ID NO: 882 - DNA, 20 bp, Artificial sequence
  Synthetic oligonucleotide
gatgggacataccattaaaa

SEQ ID NO: 883 - DNA, 20 bp, Artificial sequence
  Synthetic oligonucleotide
gtgaaagatgggacatacca

SEQ ID NO: 884 - DNA, 20 bp, Artificial sequence
  Synthetic oligonucleotide
cctgtgtgaaagatgggaca

SEQ ID NO: 885 - DNA, 20 bp, Artificial sequence
  Synthetic oligonucleotide
cattggctgctatgaattaa

SEQ ID NO: 886 - DNA, 20 bp, Artificial sequence
  Synthetic oligonucleotide
gatgacattggctgctatga

SEQ ID NO: 887 - DNA, 20 bp, Artificial sequence
  Synthetic oligonucleotide
gagaaacatgatctaatttg

SEQ ID NO: 888 - DNA, 20 bp, Artificial sequence
  Synthetic oligonucleotide
atggaaagctattgtgtggt

SEQ ID NO: 889 - DNA, 20 bp, Artificial sequence
  Synthetic oligonucleotide
gtctaaagagccaatatgag

SEQ ID NO: 890 - DNA, 20 bp, Artificial sequence
  Synthetic oligonucleotide
aatcttggtctaaagagcca

SEQ ID NO: 891 - DNA, 20 bp, Artificial sequence
  Synthetic oligonucleotide
ggagcttgagatttcacttg

SEQ ID NO: 892 - DNA, 20 bp, Artificial sequence
  Synthetic oligonucleotide
catcagatttagtaatagga

SEQ ID NO: 893 - DNA, 20 bp, Artificial sequence
  Synthetic oligonucleotide
gttattacatcagatttagt

SEQ ID NO: 894 - DNA, 20 bp, Artificial sequence
  Synthetic oligonucleotide
cagcaggaatgcctagaatc

SEQ ID NO: 895 - DNA, 20 bp, Artificial sequence
  Synthetic oligonucleotide
ctccttagacaggttttacc

SEQ ID NO: 896 - DNA, 20 bp, Artificial sequence
  Synthetic oligonucleotide
gtctattctccttagacagg

SEQ ID NO: 897 - DNA, 20 bp, Artificial sequence
  Synthetic oligonucleotide
atgaatgattgaatgtagtc

SEQ ID NO: 898 - DNA, 20 bp, Artificial sequence
  Synthetic oligonucleotide
atatgaaggctgagactgct

SEQ ID NO: 899 - DNA, 20 bp, Artificial sequence
  Synthetic oligonucleotide
ataaattatatgaaggctga

SEQ ID NO: 900 - DNA, 20 bp, Artificial sequence
  Synthetic oligonucleotide
atatttaagaacagacatgt

SEQ ID NO: 901 - DNA, 20 bp, Artificial sequence
  Synthetic oligonucleotide
atttgtaacagttactactt

SEQ ID NO: 902 - DNA, 20 bp, Artificial sequence
  Synthetic oligonucleotide
cacagcttatttgtaacagt

SEQ ID NO: 903 - DNA, 20 bp, Artificial sequence
  Synthetic oligonucleotide
gtgactaatgctaggagtgg

SEQ ID NO: 904 - DNA, 20 bp, Artificial sequence
  Synthetic oligonucleotide
gaatagagtgactaatgcta

SEQ ID NO: 905 - DNA, 20 bp, Artificial sequence
  Synthetic oligonucleotide
atgagagaatagagtgacta

SEQ ID NO: 906 - DNA, 20 bp, Artificial sequence
  Synthetic oligonucleotide
tatactgtatgtctgagttt

SEQ ID NO: 907 - DNA, 20 bp, Artificial sequence
  Synthetic oligonucleotide
aactaattcattataagcca

SEQ ID NO: 908 - DNA, 20 bp, Artificial sequence
  Synthetic oligonucleotide
tttggattttaaacatctgt

SEQ ID NO: 909 - DNA, 20 bp, Artificial sequence
  Synthetic oligonucleotide
tgtatgtgctttttggattt

SEQ ID NO: 910 - DNA, 20 bp, Artificial sequence
  Synthetic oligonucleotide
catggatttttgtatgtgct

SEQ ID NO: 911 - DNA, 20 bp, Artificial sequence
  Synthetic oligonucleotide
tcattcatggatttttgtat

SEQ ID NO: 912 - DNA, 20 bp, Artificial sequence
  Synthetic oligonucleotide
acttagacatcattcatgga

SEQ ID NO: 913 - DNA, 20 bp, Artificial sequence
  Synthetic oligonucleotide
gtgagtacttagacatcatt

SEQ ID NO: 914 - DNA, 20 bp, Artificial sequence
  Synthetic oligonucleotide
tttataagtgagtacttaga

SEQ ID NO: 915 - DNA, 20 bp, Artificial sequence
  Synthetic oligonucleotide
gtcttctactttataagtga

SEQ ID NO: 916 - DNA, 20 bp, Artificial sequence
  Synthetic oligonucleotide
atgaatgtcttctactttat

SEQ ID NO: 917 - DNA, 20 bp, Artificial sequence
  Synthetic oligonucleotide
caaatagtactgagcattta

SEQ ID NO: 918 - DNA, 20 bp, Artificial sequence
  Synthetic oligonucleotide
ttagaagatttggagctaca

SEQ ID NO: 919 - DNA, 20 bp, Artificial sequence
  Synthetic oligonucleotide
tcactattagaagatttgga

SEQ ID NO: 920 - DNA, 20 bp, Artificial sequence
  Synthetic oligonucleotide
gggttacactcactattaga

SEQ ID NO: 921 - DNA, 20 bp, Artificial sequence
  Synthetic oligonucleotide
acttacctgtcagcctttta

SEQ ID NO: 922 - DNA, 20 bp, Artificial sequence
  Synthetic oligonucleotide
cttaccagaattaagtgagt

SEQ ID NO: 923 - DNA, 20 bp, Artificial sequence
  Synthetic oligonucleotide
aatacaagtacaaatgggtt

SEQ ID NO: 924 - DNA, 20 bp, Artificial sequence
  Synthetic oligonucleotide
ctggtaaatacaagtacaaa

SEQ ID NO: 925 - DNA, 20 bp, Artificial sequence
  Synthetic oligonucleotide
ggattgctggtaaatacaag

SEQ ID NO: 926 - DNA, 20 bp, Artificial sequence
  Synthetic oligonucleotide
tcattttaaggattgctggt

SEQ ID NO: 927 - DNA, 20 bp, Artificial sequence
  Synthetic oligonucleotide
agttagtaggaagcttcatt

SEQ ID NO: 928 - DNA, 20 bp, Artificial sequence
  Synthetic oligonucleotide
gctattgagttagtaggaag

SEQ ID NO: 929 - DNA, 20 bp, Artificial sequence
  Synthetic oligonucleotide
agcatggttcttaataactt

SEQ ID NO: 930 - DNA, 20 bp, Artificial sequence
  Synthetic oligonucleotide
ctttgtagaaaaagacagga

SEQ ID NO: 931 - DNA, 20 bp, Artificial sequence
  Synthetic oligonucleotide
acctggcctttggtatttgc

SEQ ID NO: 932 - DNA, 20 bp, Artificial sequence
  Synthetic oligonucleotide
agtctttatatggataaact

SEQ ID NO: 933 - DNA, 20 bp, Artificial sequence
  Synthetic oligonucleotide
cgtcattggtagaggaatat

SEQ ID NO: 934 - DNA, 20 bp, Artificial sequence
  Synthetic oligonucleotide
gattatcctttctataatgc

SEQ ID NO: 935 - DNA, 20 bp, Artificial sequence
  Synthetic oligonucleotide
gtcttgaatcccttgatcat

SEQ ID NO: 936 - DNA, 20 bp, Artificial sequence
  Synthetic oligonucleotide
ggtgcaactaattgagttgt

SEQ ID NO: 937 - DNA, 20 bp, Artificial sequence
  Synthetic oligonucleotide
gtgttttttattggtgcaac

SEQ ID NO: 938 - DNA, 20 bp, Artificial sequence
  Synthetic oligonucleotide
attctcctgaaaagaaaagt

SEQ ID NO: 939 - DNA, 20 bp, Artificial sequence
  Synthetic oligonucleotide
atgccaccaccagcctccta

SEQ ID NO: 940 - DNA, 20 bp, Artificial sequence
  Synthetic oligonucleotide
atatcctttaacaaatgggt

SEQ ID NO: 941 - DNA, 20 bp, Artificial sequence
  Synthetic oligonucleotide
gcactatatcctttaacaaa

SEQ ID NO: 942 - DNA, 20 bp, Artificial sequence
  Synthetic oligonucleotide
acttgggcactatatccttt

SEQ ID NO: 943 - DNA, 20 bp, Artificial sequence
  Synthetic oligonucleotide
gaaacatgtcctatgagagt

SEQ ID NO: 944 - DNA, 20 bp, Artificial sequence
  Synthetic oligonucleotide
ttgagcactttaagcaaagt

SEQ ID NO: 945 - DNA, 20 bp, Artificial sequence
  Synthetic oligonucleotide
ggaatttgagcactttaagc

SEQ ID NO: 946 - DNA, 20 bp, Artificial sequence
  Synthetic oligonucleotide
tagattagacaactgtgagt

SEQ ID NO: 947 - DNA, 20 bp, Artificial sequence
  Synthetic oligonucleotide
aaaatgaaggtcaagtttga

SEQ ID NO: 948 - DNA, 20 bp, Artificial sequence
  Synthetic oligonucleotide
gtgaaagcaaaatgaaggtc

SEQ ID NO: 949 - DNA, 20 bp, Artificial sequence
  Synthetic oligonucleotide
gtattgtgaaagcaaaatga

SEQ ID NO: 950 - DNA, 20 bp, Artificial sequence
  Synthetic oligonucleotide
tggagagtatagtattgtga

SEQ ID NO: 951 - DNA, 20 bp, Artificial sequence
  Synthetic oligonucleotide
gagatttacaagtcaaaaat

SEQ ID NO: 952 - DNA, 20 bp, Artificial sequence
  Synthetic oligonucleotide
atttaactttgctgtattat

SEQ ID NO: 953 - DNA, 20 bp, Artificial sequence
  Synthetic oligonucleotide
atcaatgctaaatgaaatca

SEQ ID NO: 954 - DNA, 20 bp, Artificial sequence
  Synthetic oligonucleotide
tattttctggagattatttt

SEQ ID NO: 955 - DNA, 20 bp, Artificial sequence
  Synthetic oligonucleotide
aaaatgaatattggcaattc

SEQ ID NO: 956 - DNA, 20 bp, Artificial sequence
  Synthetic oligonucleotide
aatgcctagaatcaataaaa

SEQ ID NO: 957 - DNA, 20 bp, Artificial sequence
  Synthetic oligonucleotide
gtaaatatttgtagattagc

SEQ ID NO: 958 - DNA, 20 bp, Artificial sequence
  Synthetic oligonucleotide
acaaatgtgtaattgtttga

SEQ ID NO: 959 - DNA, 20 bp, Artificial sequence
  Synthetic oligonucleotide
tactaacaaatgtgtaattg

SEQ ID NO: 960 - DNA, 20 bp, Artificial sequence
  Synthetic oligonucleotide
tgataagtatatttaagaac

SEQ ID NO: 961 - DNA, 20 bp, Artificial sequence
  Synthetic oligonucleotide
ttaacttccaattaattgat

SEQ ID NO: 962 - DNA, 20 bp, Artificial sequence
  Synthetic oligonucleotide
tctgttattttatcttgctt

SEQ ID NO: 963 - DNA, 20 bp, Artificial sequence
  Synthetic oligonucleotide
atcacaatcctttttattaa

SEQ ID NO: 964 - DNA, 20 bp, Artificial sequence
  Synthetic oligonucleotide
agagacttgagtaataataa

SEQ ID NO: 965 - DNA, 20 bp, Artificial sequence
  Synthetic oligonucleotide
aacaaaatgaaacatgtcct

SEQ ID NO: 966 - DNA, 20 bp, Artificial sequence
  Synthetic oligonucleotide
gattttcaatttcaagcaac

SEQ ID NO: 967 - DNA, 20 bp, Artificial sequence
  Synthetic oligonucleotide
agcttaattgtgaacatttt

SEQ ID NO: 968 - DNA, 20 bp, Artificial sequence
  Synthetic oligonucleotide
gaaggagcttaattgtgaac

SEQ ID NO: 969 - DNA, 20 bp, Artificial sequence
  Synthetic oligonucleotide
caataaaaagaaggagctta

SEQ ID NO: 970 - DNA, 20 bp, Artificial sequence
  Synthetic oligonucleotide
gaacaataaaaagaaggagc

SEQ ID NO: 971 - DNA, 20 bp, Artificial sequence
  Synthetic oligonucleotide
ctggaggaaataactagagg

SEQ ID NO: 972 - DNA, 20 bp, Artificial sequence
  Synthetic oligonucleotide
attctggaggaaataactag

SEQ ID NO: 973 - DNA, 20 bp, Artificial sequence
  Synthetic oligonucleotide
tcaaatgatgaattgtcttg

SEQ ID NO: 974 - DNA, 20 bp, Artificial sequence
  Synthetic oligonucleotide
ttgattttggctctggagat

SEQ ID NO: 975 - DNA, 20 bp, Artificial sequence
  Synthetic oligonucleotide
gcaaatcttgattttggctc

SEQ ID NO: 976 - DNA, 20 bp, Artificial sequence
  Synthetic oligonucleotide
atagcaaatcttgattttgg

SEQ ID NO: 977 - DNA, 20 bp, Artificial sequence
  Synthetic oligonucleotide
cgtctaacatagcaaatctt

SEQ ID NO: 978 - DNA, 20 bp, Artificial sequence
  Synthetic oligonucleotide
tggctaaaatttttacatcg

SEQ ID NO: 979 - DNA, 20 bp, Artificial sequence
  Synthetic oligonucleotide
ccattggctaaaatttttac

SEQ ID NO: 980 - DNA, 20 bp, Artificial sequence
  Synthetic oligonucleotide
aggaggccattggctaaaat

SEQ ID NO: 981 - DNA, 20 bp, Artificial sequence
  Synthetic oligonucleotide
tgaaggaggccattggctaa

SEQ ID NO: 982 - DNA, 20 bp, Artificial sequence
  Synthetic oligonucleotide
gtcccaactgaaggaggcca

SEQ ID NO: 983 - DNA, 20 bp, Artificial sequence
  Synthetic oligonucleotide
ccatgtcccaactgaaggag

SEQ ID NO: 984 - DNA, 20 bp, Artificial sequence
  Synthetic oligonucleotide
agaccatgtcccaactgaag

SEQ ID NO: 985 - DNA, 20 bp, Artificial sequence
  Synthetic oligonucleotide
tttaagaccatgtcccaact

SEQ ID NO: 986 - DNA, 20 bp, Artificial sequence
  Synthetic oligonucleotide
gtctttaagaccatgtccca

SEQ ID NO: 987 - DNA, 20 bp, Artificial sequence
  Synthetic oligonucleotide
ggacaaagtctttaagacca

SEQ ID NO: 988 - DNA, 20 bp, Artificial sequence
  Synthetic oligonucleotide
tcttatggacaaagtcttta

SEQ ID NO: 989 - DNA, 20 bp, Artificial sequence
  Synthetic oligonucleotide
tatgtcattaatttggccct

SEQ ID NO: 990 - DNA, 20 bp, Artificial sequence
  Synthetic oligonucleotide
gatcaaatatgttgagtttt

SEQ ID NO: 991 - DNA, 20 bp, Artificial sequence
  Synthetic oligonucleotide
gactgatcaaatatgttgag

SEQ ID NO: 992 - DNA, 20 bp, Artificial sequence
  Synthetic oligonucleotide
tcttctttgatttcactggt

SEQ ID NO: 993 - DNA, 20 bp, Artificial sequence
  Synthetic oligonucleotide
cttctcagttccttttcttc

SEQ ID NO: 994 - DNA, 20 bp, Artificial sequence
  Synthetic oligonucleotide
gttcttctcagttccttttc

SEQ ID NO: 995 - DNA, 20 bp, Artificial sequence
  Synthetic oligonucleotide
tgtagttcttctcagttcct

SEQ ID NO: 996 - DNA, 20 bp, Artificial sequence
  Synthetic oligonucleotide
tatatgtagttcttctcagt

SEQ ID NO: 997 - DNA, 20 bp, Artificial sequence
  Synthetic oligonucleotide
gtttatatgtagttcttctc

SEQ ID NO: 998 - DNA, 20 bp, Artificial sequence
  Synthetic oligonucleotide
tgtagtttatatgtagttct

SEQ ID NO: 999 - DNA, 20 bp, Artificial sequence
  Synthetic oligonucleotide
gacttgtagtttatatgtag

SEQ ID NO: 1000 - DNA, 20 bp, Artificial sequence
  Synthetic oligonucleotide
tcatttttgacttgtagttt

SEQ ID NO: 1001 - DNA, 20 bp, Artificial sequence
  Synthetic oligonucleotide
cctcttcatttttgacttgt

SEQ ID NO: 1002 - DNA, 20 bp, Artificial sequence
  Synthetic oligonucleotide
tctttacctcttcatttttg

SEQ ID NO: 1003 - DNA, 20 bp, Artificial sequence
  Synthetic oligonucleotide
catattctttacctcttcat

SEQ ID NO: 1004 - DNA, 20 bp, Artificial sequence
  Synthetic oligonucleotide
gtgacatattctttacctct

SEQ ID NO: 1005 - DNA, 20 bp, Artificial sequence
  Synthetic oligonucleotide
gagttcaagtgacatattct

SEQ ID NO: 1006 - DNA, 20 bp, Artificial sequence
  Synthetic oligonucleotide
tgagttgagttcaagtgaca

SEQ ID NO: 1007 - DNA, 20 bp, Artificial sequence
  Synthetic oligonucleotide
agttttgagttgagttcaag

SEQ ID NO: 1008 - DNA, 20 bp, Artificial sequence
  Synthetic oligonucleotide
tcaagttttgagttgagttc

SEQ ID NO: 1009 - DNA, 20 bp, Artificial sequence
  Synthetic oligonucleotide
ggaggctttcaagttttgag

SEQ ID NO: 1010 - DNA, 20 bp, Artificial sequence
  Synthetic oligonucleotide
tttcttctaggaggctttca

SEQ ID NO: 1011 - DNA, 20 bp, Artificial sequence
  Synthetic oligonucleotide
attttttcttctaggaggct

SEQ ID NO: 1012 - DNA, 20 bp, Artificial sequence
  Synthetic oligonucleotide
gtagaattttttcttctagg

SEQ ID NO: 1013 - DNA, 20 bp, Artificial sequence
  Synthetic oligonucleotide
gctcttctaaatatttcact

SEQ ID NO: 1014 - DNA, 20 bp, Artificial sequence
  Synthetic oligonucleotide
agttagttagttgctcttct

SEQ ID NO: 1015 - DNA, 20 bp, Artificial sequence
  Synthetic oligonucleotide
caggttgattttgaattaag

SEQ ID NO: 1016 - DNA, 20 bp, Artificial sequence
  Synthetic oligonucleotide
tttcaggttgattttgaatt

SEQ ID NO: 1017 - DNA, 20 bp, Artificial sequence
  Synthetic oligonucleotide
ggagtttcaggttgattttg

SEQ ID NO: 1018 - DNA, 20 bp, Artificial sequence
  Synthetic oligonucleotide
gttctggagtttcaggttga

SEQ ID NO: 1019 - DNA, 20 bp, Artificial sequence
  Synthetic oligonucleotide
ttaagtgaagttacttctgg

SEQ ID NO: 1020 - DNA, 20 bp, Artificial sequence
  Synthetic oligonucleotide
tgctattatcttgtttttct

SEQ ID NO: 1021 - DNA, 20 bp, Artificial sequence
  Synthetic oligonucleotide
ggtctttgatgctattatct

SEQ ID NO: 1022 - DNA, 20 bp, Artificial sequence
  Synthetic oligonucleotide
gaaggtctttgatgctatta

SEQ ID NO: 1023 - DNA, 20 bp, Artificial sequence
  Synthetic oligonucleotide
ctggagaaggtctttgatgc

SEQ ID NO: 1024 - DNA, 20 bp, Artificial sequence
  Synthetic oligonucleotide
ctgagctgattttctatttc

SEQ ID NO: 1025 - DNA, 20 bp, Artificial sequence
  Synthetic oligonucleotide
atttctgtgggttcttgaat

SEQ ID NO: 1026 - DNA, 20 bp, Artificial sequence
  Synthetic oligonucleotide
gagaaatttctgtgggttct

SEQ ID NO: 1027 - DNA, 20 bp, Artificial sequence
  Synthetic oligonucleotide
gatagagaaatttctgtggg

SEQ ID NO: 1028 - DNA, 20 bp, Artificial sequence
  Synthetic oligonucleotide
cttggaagatagagaaattt

SEQ ID NO: 1029 - DNA, 20 bp, Artificial sequence
  Synthetic oligonucleotide
gtgctcttggcttggaagat

SEQ ID NO: 1030 - DNA, 20 bp, Artificial sequence
  Synthetic oligonucleotide
cttggtgctcttggcttgga

SEQ ID NO: 1031 - DNA, 20 bp, Artificial sequence
  Synthetic oligonucleotide
gggagtagttcttggtgctc

SEQ ID NO: 1032 - DNA, 20 bp, Artificial sequence
  Synthetic oligonucleotide
ctgaagaaagggagtagttc

SEQ ID NO: 1033 - DNA, 20 bp, Artificial sequence
  Synthetic oligonucleotide
atcatgttttacatttctta

SEQ ID NO: 1034 - DNA, 20 bp, Artificial sequence
  Synthetic oligonucleotide
gccatcatgttttacatttc

SEQ ID NO: 1035 - DNA, 20 bp, Artificial sequence
  Synthetic oligonucleotide
gaatgccatcatgttttaca

SEQ ID NO: 1036 - DNA, 20 bp, Artificial sequence
  Synthetic oligonucleotide
caggaatgccatcatgtttt

SEQ ID NO: 1037 - DNA, 20 bp, Artificial sequence
  Synthetic oligonucleotide
aaagtcaatgtgacttagta

SEQ ID NO: 1038 - DNA, 20 bp, Artificial sequence
  Synthetic oligonucleotide
aaggtatagtgatacctcat

SEQ ID NO: 1039 - DNA, 20 bp, Artificial sequence
  Synthetic oligonucleotide
actgttttcttctggaagca

SEQ ID NO: 1040 - DNA, 20 bp, Artificial sequence
  Synthetic oligonucleotide
aaataaggtatagtgatacc

SEQ ID NO: 1041 - DNA, 20 bp, Artificial sequence
  Synthetic oligonucleotide
acaaataaggtatagtgata

SEQ ID NO: 1042 - DNA, 20 bp, Artificial sequence
  Synthetic oligonucleotide
taacaaataaggtatagtga

SEQ ID NO: 1043 - DNA, 20 bp, Artificial sequence
  Synthetic oligonucleotide
tttaacaaataaggtatagt

SEQ ID NO: 1044 - DNA, 20 bp, Artificial sequence
  Synthetic oligonucleotide
atatattttaacaaataagg

SEQ ID NO: 1045 - DNA, 20 bp, Artificial sequence
  Synthetic oligonucleotide
cagtatatattttaacaaat

SEQ ID NO: 1046 - DNA, 20 bp, Artificial sequence
  Synthetic oligonucleotide
tacagtatatattttaacaa

SEQ ID NO: 1047 - DNA, 20 bp, Artificial sequence
  Synthetic oligonucleotide
tatacagtatatattttaac

SEQ ID NO: 1048 - DNA, 20 bp, Artificial sequence
  Synthetic oligonucleotide
atagtattaagtgttaaaat

SEQ ID NO: 1049 - DNA, 20 bp, Artificial sequence
  Synthetic oligonucleotide
tcatagtattaagtgttaaa

SEQ ID NO: 1050 - DNA, 20 bp, Artificial sequence
  Synthetic oligonucleotide
gttttcatagtattaagtgt

SEQ ID NO: 1051 - DNA, 20 bp, Artificial sequence
  Synthetic oligonucleotide
attatttgttttcatagtat

SEQ ID NO: 1052 - DNA, 20 bp, Artificial sequence
  Synthetic oligonucleotide
ctttacaattatttgttttc

SEQ ID NO: 1053 - DNA, 20 bp, Artificial sequence
  Synthetic oligonucleotide
attcctttacaattatttgt

SEQ ID NO: 1054 - DNA, 20 bp, Artificial sequence
  Synthetic oligonucleotide
agattcctttacaattattt

SEQ ID NO: 1055 - DNA, 20 bp, Artificial sequence
  Synthetic oligonucleotide
caagattcctttacaattat

SEQ ID NO: 1056 - DNA, 20 bp, Artificial sequence
  Synthetic oligonucleotide
gacaagattcctttacaatt

SEQ ID NO: 1057 - DNA, 20 bp, Artificial sequence
  Synthetic oligonucleotide
ctgacaagattcctttacaa

SEQ ID NO: 1058 - DNA, 20 bp, Artificial sequence
  Synthetic oligonucleotide
aatctgacaagattccttta

SEQ ID NO: 1059 - DNA, 20 bp, Artificial sequence
  Synthetic oligonucleotide
gtaatctgacaagattcctt

SEQ ID NO: 1060 - DNA, 20 bp, Artificial sequence
  Synthetic oligonucleotide
ctgtaatctgacaagattcc

SEQ ID NO: 1061 - DNA, 20 bp, Artificial sequence
  Synthetic oligonucleotide
tactgtaatctgacaagatt

SEQ ID NO: 1062 - DNA, 20 bp, Artificial sequence
  Synthetic oligonucleotide
cttactgtaatctgacaaga

SEQ ID NO: 1063 - DNA, 20 bp, Artificial sequence
  Synthetic oligonucleotide
ttcttactgtaatctgacaa

SEQ ID NO: 1064 - DNA, 20 bp, Artificial sequence
  Synthetic oligonucleotide
cattcttactgtaatctgac

SEQ ID NO: 1065 - DNA, 20 bp, Artificial sequence
  Synthetic oligonucleotide
ttcattcttactgtaatctg

SEQ ID NO: 1066 - DNA, 20 bp, Artificial sequence
  Synthetic oligonucleotide
tgttcattcttactgtaatc

SEQ ID NO: 1067 - DNA, 20 bp, Artificial sequence
  Synthetic oligonucleotide
tatgttcattcttactgtaa

SEQ ID NO: 1068 - DNA, 20 bp, Artificial sequence
  Synthetic oligonucleotide
aatatgttcattcttactgt

SEQ ID NO: 1069 - DNA, 20 bp, Artificial sequence
  Synthetic oligonucleotide
acaaatatgttcattcttac

SEQ ID NO: 1070 - DNA, 20 bp, Artificial sequence
  Synthetic oligonucleotide
cgatgccacaaatatgttca

SEQ ID NO: 1071 - DNA, 20 bp, Artificial sequence
  Synthetic oligonucleotide
ctcgatgccacaaatatgtt

SEQ ID NO: 1072 - DNA, 20 bp, Artificial sequence
  Synthetic oligonucleotide
aactcgatgccacaaatatg

SEQ ID NO: 1073 - DNA, 20 bp, Artificial sequence
  Synthetic oligonucleotide
ttaactcgatgccacaaata

SEQ ID NO: 1074 - DNA, 20 bp, Artificial sequence
  Synthetic oligonucleotide
ctttaactcgatgccacaaa

SEQ ID NO: 1075 - DNA, 20 bp, Artificial sequence
  Synthetic oligonucleotide
aactttaactcgatgccaca

SEQ ID NO: 1076 - DNA, 20 bp, Artificial sequence
  Synthetic oligonucleotide
aatataaactttaactcgat

SEQ ID NO: 1077 - DNA, 20 bp, Artificial sequence
  Synthetic oligonucleotide
gaaatataaactttaactcg

SEQ ID NO: 1078 - DNA, 20 bp, Artificial sequence
  Synthetic oligonucleotide
gggaaatataaactttaact

SEQ ID NO: 1079 - DNA, 20 bp, Artificial sequence
  Synthetic oligonucleotide
gaatcacagcatatttaggg

SEQ ID NO: 1080 - DNA, 20 bp, Artificial sequence
  Synthetic oligonucleotide
tagaatcacagcatatttag

SEQ ID NO: 1081 - DNA, 20 bp, Artificial sequence
  Synthetic oligonucleotide
gtattagaatcacagcatat

SEQ ID NO: 1082 - DNA, 20 bp, Artificial sequence
  Synthetic oligonucleotide
atgtattagaatcacagcat

SEQ ID NO: 1083 - DNA, 20 bp, Artificial sequence
  Synthetic oligonucleotide
gaatgtattagaatcacagc

SEQ ID NO: 1084 - DNA, 20 bp, Artificial sequence
  Synthetic oligonucleotide
acgaatgtattagaatcaca

SEQ ID NO: 1085 - DNA, 20 bp, Artificial sequence
  Synthetic oligonucleotide
acacgaatgtattagaatca

SEQ ID NO: 1086 - DNA, 20 bp, Artificial sequence
  Synthetic oligonucleotide
ctacacgaatgtattagaat

SEQ ID NO: 1087 - DNA, 20 bp, Artificial sequence
  Synthetic oligonucleotide
acctacacgaatgtattaga

SEQ ID NO: 1088 - DNA, 20 bp, Artificial sequence
  Synthetic oligonucleotide
aaacctacacgaatgtatta

SEQ ID NO: 1089 - DNA, 20 bp, Artificial sequence
  Synthetic oligonucleotide
gaaaacctacacgaatgtat

SEQ ID NO: 1090 - DNA, 20 bp, Artificial sequence
  Synthetic oligonucleotide
ttgaaaacctacacgaatgt

SEQ ID NO: 1091 - DNA, 20 bp, Artificial sequence
  Synthetic oligonucleotide
acttgaaaacctacacgaat

SEQ ID NO: 1092 - DNA, 20 bp, Artificial sequence
  Synthetic oligonucleotide
ctacttgaaaacctacacga

SEQ ID NO: 1093 - DNA, 20 bp, Artificial sequence
  Synthetic oligonucleotide
tatttctacttgaaaaccta

SEQ ID NO: 1094 - DNA, 20 bp, Artificial sequence
  Synthetic oligonucleotide
tttatttctacttgaaaacc

SEQ ID NO: 1095 - DNA, 20 bp, Artificial sequence
  Synthetic oligonucleotide
ggtttatttctacttgaaaa

SEQ ID NO: 1096 - DNA, 20 bp, Artificial sequence
  Synthetic oligonucleotide
gaggtttatttctacttgaa

SEQ ID NO: 1097 - DNA, 20 bp, Artificial sequence
  Synthetic oligonucleotide
ttacgaggtttatttctact

SEQ ID NO: 1098 - DNA, 20 bp, Artificial sequence
  Synthetic oligonucleotide
tgttacgaggtttatttcta

SEQ ID NO: 1099 - DNA, 20 bp, Artificial sequence
  Synthetic oligonucleotide
cttgttacgaggtttatttc

SEQ ID NO: 1100 - DNA, 20 bp, Artificial sequence
  Synthetic oligonucleotide
aacttgttacgaggtttatt

SEQ ID NO: 1101 - DNA, 20 bp, Artificial sequence
  Synthetic oligonucleotide
gtaacttgttacgaggttta

SEQ ID NO: 1102 - DNA, 20 bp, Artificial sequence
  Synthetic oligonucleotide
cagtaacttgttacgaggtt

SEQ ID NO: 1103 - DNA, 20 bp, Artificial sequence
  Synthetic oligonucleotide
ttcagtaacttgttacgagg

SEQ ID NO: 1104 - DNA, 20 bp, Artificial sequence
  Synthetic oligonucleotide
cgttcagtaacttgttacga

SEQ ID NO: 1105 - DNA, 20 bp, Artificial sequence
  Synthetic oligonucleotide
cttgtcaggctgtttaaacg

SEQ ID NO: 1106 - DNA, 20 bp, Artificial sequence
  Synthetic oligonucleotide
tgcttgtcaggctgtttaaa

SEQ ID NO: 1107 - DNA, 20 bp, Artificial sequence
  Synthetic oligonucleotide
tatacatgcttgtcaggctg

SEQ ID NO: 1108 - DNA, 20 bp, Artificial sequence
  Synthetic oligonucleotide
tatatacatgcttgtcaggc

SEQ ID NO: 1109 - DNA, 20 bp, Artificial sequence
  Synthetic oligonucleotide
catatatacatgcttgtcag

SEQ ID NO: 1110 - DNA, 20 bp, Artificial sequence
  Synthetic oligonucleotide
tggaactgttttcttctgga

SEQ ID NO: 1111 - DNA, 20 bp, Artificial sequence
  Synthetic oligonucleotide
cgtggaactgttttcttctg

SEQ ID NO: 1112 - DNA, 20 bp, Artificial sequence
  Synthetic oligonucleotide
tcttgattttcaatttcaag

SEQ ID NO: 1113 - DNA, 20 bp, Artificial sequence
  Synthetic oligonucleotide
ttttatcttgattttcaatt

SEQ ID NO: 1114 - DNA, 20 bp, Artificial sequence
  Synthetic oligonucleotide
catttttatcttgattttca

SEQ ID NO: 1115 - DNA, 20 bp, Artificial sequence
  Synthetic oligonucleotide
attgtgaacatttttatctt

SEQ ID NO: 1116 - DNA, 20 bp, Artificial sequence
  Synthetic oligonucleotide
taattgtgaacatttttatc

SEQ ID NO: 1117 - DNA, 20 bp, Artificial sequence
  Synthetic oligonucleotide
aagaaggagcttaattgtga

SEQ ID NO: 1118 - DNA, 20 bp, Artificial sequence
  Synthetic oligonucleotide
aaaagaaggagcttaattgt

SEQ ID NO: 1119 - DNA, 20 bp, Artificial sequence
  Synthetic oligonucleotide
taaaaagaaggagcttaatt

SEQ ID NO: 1120 - DNA, 20 bp, Artificial sequence
  Synthetic oligonucleotide
taactagaggaacaataaaa

SEQ ID NO: 1121 - DNA, 20 bp, Artificial sequence
  Synthetic oligonucleotide
aataactagaggaacaataa

SEQ ID NO: 1122 - DNA, 20 bp, Artificial sequence
  Synthetic oligonucleotide
gaaataactagaggaacaat

SEQ ID NO: 1123 - DNA, 20 bp, Artificial sequence
  Synthetic oligonucleotide
aggaaataactagaggaaca

SEQ ID NO: 1124 - DNA, 20 bp, Artificial sequence
  Synthetic oligonucleotide
ggaggaaataactagaggaa

SEQ ID NO: 1125 - DNA, 20 bp, Artificial sequence
  Synthetic oligonucleotide
caattctggaggaaataact

SEQ ID NO: 1126 - DNA, 20 bp, Artificial sequence
  Synthetic oligonucleotide
atcaattctggaggaaataa

SEQ ID NO: 1127 - DNA, 20 bp, Artificial sequence
  Synthetic oligonucleotide
cttgatcaattctggaggaa

SEQ ID NO: 1128 - DNA, 20 bp, Artificial sequence
  Synthetic oligonucleotide
gtcttgatcaattctggagg

SEQ ID NO: 1129 - DNA, 20 bp, Artificial sequence
  Synthetic oligonucleotide
ttgtcttgatcaattctgga

SEQ ID NO: 1130 - DNA, 20 bp, Artificial sequence
  Synthetic oligonucleotide
aattgtcttgatcaattctg

SEQ ID NO: 1131 - DNA, 20 bp, Artificial sequence
  Synthetic oligonucleotide
tgaattgtcttgatcaattc

SEQ ID NO: 1132 - DNA, 20 bp, Artificial sequence
  Synthetic oligonucleotide
gatgaattgtcttgatcaat

SEQ ID NO: 1133 - DNA, 20 bp, Artificial sequence
  Synthetic oligonucleotide
atgatgaattgtcttgatca

SEQ ID NO: 1134 - DNA, 20 bp, Artificial sequence
  Synthetic oligonucleotide
aaatgatgaattgtcttgat

SEQ ID NO: 1135 - DNA, 20 bp, Artificial sequence
  Synthetic oligonucleotide
aatcaaatgatgaattgtct

SEQ ID NO: 1136 - DNA, 20 bp, Artificial sequence
  Synthetic oligonucleotide
agaatcaaatgatgaattgt

SEQ ID NO: 1137 - DNA, 20 bp, Artificial sequence
  Synthetic oligonucleotide
tagagaatcaaatgatgaat

SEQ ID NO: 1138 - DNA, 20 bp, Artificial sequence
  Synthetic oligonucleotide
ctggagatagagaatcaaat

SEQ ID NO: 1139 - DNA, 20 bp, Artificial sequence
  Synthetic oligonucleotide
ctctggagatagagaatcaa

SEQ ID NO: 1140 - DNA, 20 bp, Artificial sequence
  Synthetic oligonucleotide
ttggctctggagatagagaa

SEQ ID NO: 1141 - DNA, 20 bp, Artificial sequence
  Synthetic oligonucleotide
attttggctctggagataga

SEQ ID NO: 1142 - DNA, 20 bp, Artificial sequence
  Synthetic oligonucleotide
aatcttgattttggctctgg

SEQ ID NO: 1143 - DNA, 20 bp, Artificial sequence
  Synthetic oligonucleotide
acatagcaaatcttgatttt

SEQ ID NO: 1144 - DNA, 20 bp, Artificial sequence
  Synthetic oligonucleotide
taacatagcaaatcttgatt

SEQ ID NO: 1145 - DNA, 20 bp, Artificial sequence
  Synthetic oligonucleotide
tctaacatagcaaatcttga

SEQ ID NO: 1146 - DNA, 20 bp, Artificial sequence
  Synthetic oligonucleotide
attggctaaaatttttacat

SEQ ID NO: 1147 - DNA, 20 bp, Artificial sequence
  Synthetic oligonucleotide
ggccattggctaaaattttt

SEQ ID NO: 1148 - DNA, 20 bp, Artificial sequence
  Synthetic oligonucleotide
gaggccattggctaaaattt

SEQ ID NO: 1149 - DNA, 20 bp, Artificial sequence
  Synthetic oligonucleotide
actgaaggaggccattggct

SEQ ID NO: 1150 - DNA, 20 bp, Artificial sequence
  Synthetic oligonucleotide
caactgaaggaggccattgg

SEQ ID NO: 1151 - DNA, 20 bp, Artificial sequence
  Synthetic oligonucleotide
cccaactgaaggaggccatt

SEQ ID NO: 1152 - DNA, 20 bp, Artificial sequence
  Synthetic oligonucleotide
atgtcccaactgaaggaggc

SEQ ID NO: 1153 - DNA, 20 bp, Artificial sequence
  Synthetic oligonucleotide
taagaccatgtcccaactga

SEQ ID NO: 1154 - DNA, 20 bp, Artificial sequence
  Synthetic oligonucleotide
aagtctttaagaccatgtcc

SEQ ID NO: 1155 - DNA, 20 bp, Artificial sequence
  Synthetic oligonucleotide
caaagtctttaagaccatgt

SEQ ID NO: 1156 - DNA, 20 bp, Artificial sequence
  Synthetic oligonucleotide
tatggacaaagtctttaaga

SEQ ID NO: 1157 - DNA, 20 bp, Artificial sequence
  Synthetic oligonucleotide
cgtcttatggacaaagtctt

SEQ ID NO: 1158 - DNA, 20 bp, Artificial sequence
  Synthetic oligonucleotide
aatatgtcattaatttggcc

SEQ ID NO: 1159 - DNA, 20 bp, Artificial sequence
  Synthetic oligonucleotide
gaaatatgtcattaatttgg

SEQ ID NO: 1160 - DNA, 20 bp, Artificial sequence
  Synthetic oligonucleotide
tttgaaatatgtcattaatt

SEQ ID NO: 1161 - DNA, 20 bp, Artificial sequence
  Synthetic oligonucleotide
agtttttgaaatatgtcatt

SEQ ID NO: 1162 - DNA, 20 bp, Artificial sequence
  Synthetic oligonucleotide
tgagtttttgaaatatgtca

SEQ ID NO: 1163 - DNA, 20 bp, Artificial sequence
  Synthetic oligonucleotide
caaatatgttgagtttttga

SEQ ID NO: 1164 - DNA, 20 bp, Artificial sequence
  Synthetic oligonucleotide
ctgatcaaatatgttgagtt

SEQ ID NO: 1165 - DNA, 20 bp, Artificial sequence
  Synthetic oligonucleotide
aagactgatcaaatatgttg

SEQ ID NO: 1166 - DNA, 20 bp, Artificial sequence
  Synthetic oligonucleotide
taaaaagactgatcaaatat

SEQ ID NO: 1167 - DNA, 20 bp, Artificial sequence
  Synthetic oligonucleotide
cataaaaagactgatcaaat

SEQ ID NO: 1168 - DNA, 20 bp, Artificial sequence
  Synthetic oligonucleotide
atcataaaaagactgatcaa

SEQ ID NO: 1169 - DNA, 20 bp, Artificial sequence
  Synthetic oligonucleotide
tagatcataaaaagactgat

SEQ ID NO: 1170 - DNA, 20 bp, Artificial sequence
  Synthetic oligonucleotide
gatagatcataaaaagactg

SEQ ID NO: 1171 - DNA, 20 bp, Artificial sequence
  Synthetic oligonucleotide
gcgatagatcataaaaagac

SEQ ID NO: 1172 - DNA, 20 bp, Artificial sequence
  Synthetic oligonucleotide
cagcgatagatcataaaaag

SEQ ID NO: 1173 - DNA, 20 bp, Artificial sequence
  Synthetic oligonucleotide
tgcagcgatagatcataaaa

SEQ ID NO: 1174 - DNA, 20 bp, Artificial sequence
  Synthetic oligonucleotide
tttgcagcgatagatcataa

SEQ ID NO: 1175 - DNA, 20 bp, Artificial sequence
  Synthetic oligonucleotide
ggtttgcagcgatagatcat

SEQ ID NO: 1176 - DNA, 20 bp, Artificial sequence
  Synthetic oligonucleotide
ctggtttgcagcgatagatc

SEQ ID NO: 1177 - DNA, 20 bp, Artificial sequence
  Synthetic oligonucleotide
cactggtttgcagcgataga

SEQ ID NO: 1178 - DNA, 20 bp, Artificial sequence
  Synthetic oligonucleotide
atttcactggtttgcagcga

SEQ ID NO: 1179 - DNA, 20 bp, Artificial sequence
  Synthetic oligonucleotide
ttgatttcactggtttgcag

SEQ ID NO: 1180 - DNA, 20 bp, Artificial sequence
  Synthetic oligonucleotide
cttcttctttgatttcactg

SEQ ID NO: 1181 - DNA, 20 bp, Artificial sequence
  Synthetic oligonucleotide
gttccttttcttcttctttg

SEQ ID NO: 1182 - DNA, 20 bp, Artificial sequence
  Synthetic oligonucleotide
ttgtatgttcacctctgtta

SEQ ID NO: 1183 - DNA, 20 bp, Artificial sequence
  Synthetic oligonucleotide
cttgtatgttcacctctgtt

SEQ ID NO: 1184 - DNA, 20 bp, Artificial sequence
  Synthetic oligonucleotide
gccacttgtatgttcacctc

SEQ ID NO: 1185 - DNA, 20 bp, Artificial sequence
  Synthetic oligonucleotide
tgccacttgtatgttcacct

SEQ ID NO: 1186 - DNA, 20 bp, Artificial sequence
  Synthetic oligonucleotide
atgccacttgtatgttcacc

SEQ ID NO: 1187 - DNA, 20 bp, Artificial sequence
  Synthetic oligonucleotide
catgccacttgtatgttcac

SEQ ID NO: 1188 - DNA, 20 bp, Artificial sequence
  Synthetic oligonucleotide
acatgccacttgtatgttca

SEQ ID NO: 1189 - DNA, 20 bp, Artificial sequence
  Synthetic oligonucleotide
tacatgccacttgtatgttc

SEQ ID NO: 1190 - DNA, 20 bp, Artificial sequence
  Synthetic oligonucleotide
gcatacatgccacttgtatg

SEQ ID NO: 1191 - DNA, 20 bp, Artificial sequence
  Synthetic oligonucleotide
ggcatacatgccacttgtat

SEQ ID NO: 1192 - DNA, 20 bp, Artificial sequence
  Synthetic oligonucleotide
tggcatacatgccacttgta

SEQ ID NO: 1193 - DNA, 20 bp, Artificial sequence
  Synthetic oligonucleotide
atggcatacatgccacttgt

SEQ ID NO: 1194 - DNA, 20 bp, Artificial sequence
  Synthetic oligonucleotide
tctgatggcatacatgccac

SEQ ID NO: 1195 - DNA, 20 bp, Artificial sequence
  Synthetic oligonucleotide
gtctgatggcatacatgcca

SEQ ID NO: 1196 - DNA, 20 bp, Artificial sequence
  Synthetic oligonucleotide
gggtctgatggcatacatgc

SEQ ID NO: 1197 - DNA, 20 bp, Artificial sequence
  Synthetic oligonucleotide
tgggtctgatggcatacatg

SEQ ID NO: 1198 - DNA, 20 bp, Artificial sequence
  Synthetic oligonucleotide
ctgggtctgatggcatacat

SEQ ID NO: 1199 - DNA, 20 bp, Artificial sequence
  Synthetic oligonucleotide
gagagttgctgggtctgatg

SEQ ID NO: 1200 - DNA, 20 bp, Artificial sequence
  Synthetic oligonucleotide
tgagagttgctgggtctgat

SEQ ID NO: 1201 - DNA, 20 bp, Artificial sequence
  Synthetic oligonucleotide
ttgagagttgctgggtctga

SEQ ID NO: 1202 - DNA, 20 bp, Artificial sequence
  Synthetic oligonucleotide
cttgagagttgctgggtctg

SEQ ID NO: 1203 - DNA, 20 bp, Artificial sequence
  Synthetic oligonucleotide
acttgagagttgctgggtct

SEQ ID NO: 1204 - DNA, 20 bp, Artificial sequence
  Synthetic oligonucleotide
aacttgagagttgctgggtc

SEQ ID NO: 1205 - DNA, 20 bp, Artificial sequence
  Synthetic oligonucleotide
gaaaaacttgagagttgctg

SEQ ID NO: 1206 - DNA, 20 bp, Artificial sequence
  Synthetic oligonucleotide
tgaaaaacttgagagttgct

SEQ ID NO: 1207 - DNA, 20 bp, Artificial sequence
  Synthetic oligonucleotide
atgaaaaacttgagagttgc

SEQ ID NO: 1208 - DNA, 20 bp, Artificial sequence
  Synthetic oligonucleotide
catgaaaaacttgagagttg

SEQ ID NO: 1209 - DNA, 20 bp, Artificial sequence
  Synthetic oligonucleotide
gtagacatgaaaaacttgag

SEQ ID NO: 1210 - DNA, 20 bp, Artificial sequence
  Synthetic oligonucleotide
cagtagacatgaaaaacttg

SEQ ID NO: 1211 - DNA, 20 bp, Artificial sequence
  Synthetic oligonucleotide
taacatcacagtagacatga

SEQ ID NO: 1212 - DNA, 20 bp, Artificial sequence
  Synthetic oligonucleotide
ataacatcacagtagacatg

SEQ ID NO: 1213 - DNA, 20 bp, Artificial sequence
  Synthetic oligonucleotide
tataacatcacagtagacat

SEQ ID NO: 1214 - DNA, 20 bp, Artificial sequence
  Synthetic oligonucleotide
atataacatcacagtagaca

SEQ ID NO: 1215 - DNA, 20 bp, Artificial sequence
  Synthetic oligonucleotide
gatataacatcacagtagac

SEQ ID NO: 1216 - DNA, 20 bp, Artificial sequence
  Synthetic oligonucleotide
tgatataacatcacagtaga

SEQ ID NO: 1217 - DNA, 20 bp, Artificial sequence
  Synthetic oligonucleotide
ctgatataacatcacagtag

SEQ ID NO: 1218 - DNA, 20 bp, Artificial sequence
  Synthetic oligonucleotide
cctgatataacatcacagta

SEQ ID NO: 1219 - DNA, 20 bp, Artificial sequence
  Synthetic oligonucleotide
acctgatataacatcacagt

SEQ ID NO: 1220 - DNA, 20 bp, Artificial sequence
  Synthetic oligonucleotide
tacctgatataacatcacag

SEQ ID NO: 1221 - DNA, 20 bp, Artificial sequence
  Synthetic oligonucleotide
ctacctgatataacatcaca

SEQ ID NO: 1222 - DNA, 20 bp, Artificial sequence
  Synthetic oligonucleotide
actacctgatataacatcac

SEQ ID NO: 1223 - DNA, 20 bp, Artificial sequence
  Synthetic oligonucleotide
gactacctgatataacatca

SEQ ID NO: 1224 - DNA, 20 bp, Artificial sequence
  Synthetic oligonucleotide
ggactacctgatataacatc

SEQ ID NO: 1225 - DNA, 20 bp, Artificial sequence
  Synthetic oligonucleotide
tggactacctgatataacat

SEQ ID NO: 1226 - DNA, 20 bp, Artificial sequence
  Synthetic oligonucleotide
atggactacctgatataaca

SEQ ID NO: 1227 - DNA, 20 bp, Artificial sequence
  Synthetic oligonucleotide
catggactacctgatataac

SEQ ID NO: 1228 - DNA, 20 bp, Artificial sequence
  Synthetic oligonucleotide
ccatggactacctgatataa

SEQ ID NO: 1229 - DNA, 20 bp, Artificial sequence
  Synthetic oligonucleotide
tccatggactacctgatata

SEQ ID NO: 1230 - DNA, 20 bp, Artificial sequence
  Synthetic oligonucleotide
gtccatggactacctgatat

SEQ ID NO: 1231 - DNA, 20 bp, Artificial sequence
  Synthetic oligonucleotide
tgtccatggactacctgata

SEQ ID NO: 1232 - DNA, 20 bp, Artificial sequence
  Synthetic oligonucleotide
atgtccatggactacctgat

SEQ ID NO: 1233 - DNA, 20 bp, Artificial sequence
  Synthetic oligonucleotide
aatgtccatggactacctga

SEQ ID NO: 1234 - DNA, 20 bp, Artificial sequence
  Synthetic oligonucleotide
taatgtccatggactacctg

SEQ ID NO: 1235 - DNA, 20 bp, Artificial sequence
  Synthetic oligonucleotide
ttaatgtccatggactacct

SEQ ID NO: 1236 - DNA, 20 bp, Artificial sequence
  Synthetic oligonucleotide
attaatgtccatggactacc

SEQ ID NO: 1237 - DNA, 20 bp, Artificial sequence
  Synthetic oligonucleotide
aattaatgtccatggactac

SEQ ID NO: 1238 - DNA, 20 bp, Artificial sequence
  Synthetic oligonucleotide
gttgaattaatgtccatgga

SEQ ID NO: 1239 - DNA, 20 bp, Artificial sequence
  Synthetic oligonucleotide
tgttgaattaatgtccatgg

SEQ ID NO: 1240 - DNA, 20 bp, Artificial sequence
  Synthetic oligonucleotide
atgttgaattaatgtccatg

SEQ ID NO: 1241 - DNA, 20 bp, Artificial sequence
  Synthetic oligonucleotide
gatgttgaattaatgtccat

SEQ ID NO: 1242 - DNA, 20 bp, Artificial sequence
  Synthetic oligonucleotide
cgatgttgaattaatgtcca

SEQ ID NO: 1243 - DNA, 20 bp, Artificial sequence
  Synthetic oligonucleotide
tcgatgttgaattaatgtcc

SEQ ID NO: 1244 - DNA, 20 bp, Artificial sequence
  Synthetic oligonucleotide
ttcgatgttgaattaatgtc

SEQ ID NO: 1245 - DNA, 20 bp, Artificial sequence
  Synthetic oligonucleotide
attcgatgttgaattaatgt

SEQ ID NO: 1246 - DNA, 20 bp, Artificial sequence
  Synthetic oligonucleotide
tattcgatgttgaattaatg

SEQ ID NO: 1247 - DNA, 20 bp, Artificial sequence
  Synthetic oligonucleotide
ctattcgatgttgaattaat

SEQ ID NO: 1248 - DNA, 20 bp, Artificial sequence
  Synthetic oligonucleotide
atctattcgatgttgaatta

SEQ ID NO: 1249 - DNA, 20 bp, Artificial sequence
  Synthetic oligonucleotide
catctattcgatgttgaatt

SEQ ID NO: 1250 - DNA, 20 bp, Artificial sequence
  Synthetic oligonucleotide
ccatctattcgatgttgaat

SEQ ID NO: 1251 - DNA, 20 bp, Artificial sequence
  Synthetic oligonucleotide
tccatctattcgatgttgaa

SEQ ID NO: 1252 - DNA, 20 bp, Artificial sequence
  Synthetic oligonucleotide
atccatctattcgatgttga

SEQ ID NO: 1253 - DNA, 20 bp, Artificial sequence
  Synthetic oligonucleotide
gatccatctattcgatgttg

SEQ ID NO: 1254 - DNA, 20 bp, Artificial sequence
  Synthetic oligonucleotide
tgatccatctattcgatgtt

SEQ ID NO: 1255 - DNA, 20 bp, Artificial sequence
  Synthetic oligonucleotide
gtgatccatctattcgatgt

SEQ ID NO: 1256 - DNA, 20 bp, Artificial sequence
  Synthetic oligonucleotide
tgtgatccatctattcgatg

SEQ ID NO: 1257 - DNA, 20 bp, Artificial sequence
  Synthetic oligonucleotide
ttgtgatccatctattcgat

SEQ ID NO: 1258 - DNA, 20 bp, Artificial sequence
  Synthetic oligonucleotide
tttaggttgttttctccaca

SEQ ID NO: 1259 - DNA, 20 bp, Artificial sequence
  Synthetic oligonucleotide
atttaggttgttttctccac

SEQ ID NO: 1260 - DNA, 20 bp, Artificial sequence
  Synthetic oligonucleotide
taccatttaggttgttttct

SEQ ID NO: 1261 - DNA, 20 bp, Artificial sequence
  Synthetic oligonucleotide
gttatatttaccatttaggt

SEQ ID NO: 1262 - DNA, 20 bp, Artificial sequence
  Synthetic oligonucleotide
tgttatatttaccatttagg

SEQ ID NO: 1263 - DNA, 20 bp, Artificial sequence
  Synthetic oligonucleotide
ttgttatatttaccatttag

SEQ ID NO: 1264 - DNA, 20 bp, Artificial sequence
  Synthetic oligonucleotide
tttgttatatttaccattta

SEQ ID NO: 1265 - DNA, 20 bp, Artificial sequence
  Synthetic oligonucleotide
tggtttgttatatttaccat

SEQ ID NO: 1266 - DNA, 20 bp, Artificial sequence
  Synthetic oligonucleotide
ctcttggtttgttatattta

SEQ ID NO: 1267 - DNA, 20 bp, Artificial sequence
  Synthetic oligonucleotide
gctcttggtttgttatattt

SEQ ID NO: 1268 - DNA, 20 bp, Artificial sequence
  Synthetic oligonucleotide
tgctcttggtttgttatatt

SEQ ID NO: 1269 - DNA, 20 bp, Artificial sequence
  Synthetic oligonucleotide
ttttgctcttggtttgttat

SEQ ID NO: 1270 - DNA, 20 bp, Artificial sequence
  Synthetic oligonucleotide
attttgctcttggtttgtta

SEQ ID NO: 1271 - DNA, 20 bp, Artificial sequence
  Synthetic oligonucleotide
gattttgctcttggtttgtt

SEQ ID NO: 1272 - DNA, 20 bp, Artificial sequence
  Synthetic oligonucleotide
agattttgctcttggtttgt

SEQ ID NO: 1273 - DNA, 20 bp, Artificial sequence
  Synthetic oligonucleotide
tagattttgctcttggtttg

SEQ ID NO: 1274 - DNA, 20 bp, Artificial sequence
  Synthetic oligonucleotide
ctctctggcttagattttgc

SEQ ID NO: 1275 - DNA, 20 bp, Artificial sequence
  Synthetic oligonucleotide
cctctctggcttagattttg

SEQ ID NO: 1276 - DNA, 20 bp, Artificial sequence
  Synthetic oligonucleotide
tcctctctggcttagatttt

SEQ ID NO: 1277 - DNA, 20 bp, Artificial sequence
  Synthetic oligonucleotide
cttctcctctctggcttaga

SEQ ID NO: 1278 - DNA, 20 bp, Artificial sequence
  Synthetic oligonucleotide
tcttctcctctctggcttag

SEQ ID NO: 1279 - DNA, 20 bp, Artificial sequence
  Synthetic oligonucleotide
ctcttctcctctctggctta

SEQ ID NO: 1280 - DNA, 20 bp, Artificial sequence
  Synthetic oligonucleotide
taatcctcttctcctctctg

SEQ ID NO: 1281 - DNA, 20 bp, Artificial sequence
  Synthetic oligonucleotide
ataatcctcttctcctctct

SEQ ID NO: 1282 - DNA, 20 bp, Artificial sequence
  Synthetic oligonucleotide
gataatcctcttctcctctc

SEQ ID NO: 1283 - DNA, 20 bp, Artificial sequence
  Synthetic oligonucleotide
agataatcctcttctcctct

SEQ ID NO: 1284 - DNA, 20 bp, Artificial sequence
  Synthetic oligonucleotide
aagataatcctcttctcctc

SEQ ID NO: 1285 - DNA, 20 bp, Artificial sequence
  Synthetic oligonucleotide
caagataatcctcttctcct

SEQ ID NO: 1286 - DNA, 20 bp, Artificial sequence
  Synthetic oligonucleotide
ccaagataatcctcttctcc

SEQ ID NO: 1287 - DNA, 20 bp, Artificial sequence
  Synthetic oligonucleotide
tccaagataatcctcttctc

SEQ ID NO: 1288 - DNA, 20 bp, Artificial sequence
  Synthetic oligonucleotide
ttccaagataatcctcttct

SEQ ID NO: 1289 - DNA, 20 bp, Artificial sequence
  Synthetic oligonucleotide
cttccaagataatcctcttc

SEQ ID NO: 1290 - DNA, 20 bp, Artificial sequence
  Synthetic oligonucleotide
acttccaagataatcctctt

SEQ ID NO: 1291 - DNA, 20 bp, Artificial sequence
  Synthetic oligonucleotide
gacttccaagataatcctct

SEQ ID NO: 1292 - DNA, 20 bp, Artificial sequence
  Synthetic oligonucleotide
agacttccaagataatcctc

SEQ ID NO: 1293 - DNA, 20 bp, Artificial sequence
  Synthetic oligonucleotide
gagacttccaagataatcct

SEQ ID NO: 1294 - DNA, 20 bp, Artificial sequence
  Synthetic oligonucleotide
tgagacttccaagataatcc

SEQ ID NO: 1295 - DNA, 20 bp, Artificial sequence
  Synthetic oligonucleotide
ttgagacttccaagataatc

SEQ ID NO: 1296 - DNA, 20 bp, Artificial sequence
  Synthetic oligonucleotide
tttgagacttccaagataat

SEQ ID NO: 1297 - DNA, 20 bp, Artificial sequence
  Synthetic oligonucleotide
ttttgagacttccaagataa

SEQ ID NO: 1298 - DNA, 20 bp, Artificial sequence
  Synthetic oligonucleotide
attttgagacttccaagata

SEQ ID NO: 1299 - DNA, 20 bp, Artificial sequence
  Synthetic oligonucleotide
ccattttgagacttccaaga

SEQ ID NO: 1300 - DNA, 20 bp, Artificial sequence
  Synthetic oligonucleotide
cttccattttgagacttcca

SEQ ID NO: 1301 - DNA, 20 bp, Artificial sequence
  Synthetic oligonucleotide
taaccttccattttgagact

SEQ ID NO: 1302 - DNA, 20 bp, Artificial sequence
  Synthetic oligonucleotide
ataaccttccattttgagac

SEQ ID NO: 1303 - DNA, 20 bp, Artificial sequence
  Synthetic oligonucleotide
tataaccttccattttgaga

SEQ ID NO: 1304 - DNA, 20 bp, Artificial sequence
  Synthetic oligonucleotide
gtataaccttccattttgag

SEQ ID NO: 1305 - DNA, 20 bp, Artificial sequence
  Synthetic oligonucleotide
gagtataaccttccattttg

SEQ ID NO: 1306 - DNA, 20 bp, Artificial sequence
  Synthetic oligonucleotide
agagtataaccttccatttt

SEQ ID NO: 1307 - DNA, 20 bp, Artificial sequence
  Synthetic oligonucleotide
ttatagagtataaccttcca

SEQ ID NO: 1308 - DNA, 20 bp, Artificial sequence
  Synthetic oligonucleotide
gattttatagagtataacct

SEQ ID NO: 1309 - DNA, 20 bp, Artificial sequence
  Synthetic oligonucleotide
tgattttatagagtataacc

SEQ ID NO: 1310 - DNA, 20 bp, Artificial sequence
  Synthetic oligonucleotide
ttgattttatagagtataac

SEQ ID NO: 1311 - DNA, 20 bp, Artificial sequence
  Synthetic oligonucleotide
gttgattttatagagtataa

SEQ ID NO: 1312 - DNA, 20 bp, Artificial sequence
  Synthetic oligonucleotide
tttggttgattttatagagt

SEQ ID NO: 1313 - DNA, 20 bp, Artificial sequence
  Synthetic oligonucleotide
ggatcaacattttggttgat

SEQ ID NO: 1314 - DNA, 20 bp, Artificial sequence
  Synthetic oligonucleotide
tggatcaacattttggttga

SEQ ID NO: 1315 - DNA, 20 bp, Artificial sequence
  Synthetic oligonucleotide
atggatcaacattttggttg

SEQ ID NO: 1316 - DNA, 20 bp, Artificial sequence
  Synthetic oligonucleotide
aatctgttggatggatcaac

SEQ ID NO: 1317 - DNA, 20 bp, Artificial sequence
  Synthetic oligonucleotide
gaatctgttggatggatcaa

SEQ ID NO: 1318 - DNA, 20 bp, Artificial sequence
  Synthetic oligonucleotide
ttctgaatctgttggatgga

SEQ ID NO: 1319 - DNA, 20 bp, Artificial sequence
  Synthetic oligonucleotide
tttctgaatctgttggatgg

SEQ ID NO: 1320 - DNA, 20 bp, Artificial sequence
  Synthetic oligonucleotide
ctttctgaatctgttggatg

SEQ ID NO: 1321 - DNA, 20 bp, Artificial sequence
  Synthetic oligonucleotide
aaagctttctgaatctgttg

SEQ ID NO: 1322 - DNA, 20 bp, Artificial sequence
  Synthetic oligonucleotide
ttgcctcagttcattcaaag

SEQ ID NO: 1323 - DNA, 20 bp, Artificial sequence
  Synthetic oligonucleotide
aaatttgcctcagttcattc

SEQ ID NO: 1324 - DNA, 20 bp, Artificial sequence
  Synthetic oligonucleotide
cttttaaatttgcctcagtt

SEQ ID NO: 1325 - DNA, 20 bp, Artificial sequence
  Synthetic oligonucleotide
tattgccttttaaatttgcc

SEQ ID NO: 1326 - DNA, 20 bp, Artificial sequence
  Synthetic oligonucleotide
ttattgccttttaaatttgc

SEQ ID NO: 1327 - DNA, 20 bp, Artificial sequence
  Synthetic oligonucleotide
ttaaattattgccttttaaa

SEQ ID NO: 1328 - DNA, 20 bp, Artificial sequence
  Synthetic oligonucleotide
tttaaattattgccttttaa

SEQ ID NO: 1329 - DNA, 20 bp, Artificial sequence
  Synthetic oligonucleotide
gtttaaattattgcctttta

SEQ ID NO: 1330 - DNA, 20 bp, Artificial sequence
  Synthetic oligonucleotide
tgtttaaattattgcctttt

SEQ ID NO: 1331 - DNA, 20 bp, Artificial sequence
  Synthetic oligonucleotide
atgtttaaattattgccttt

SEQ ID NO: 1332 - DNA, 20 bp, Artificial sequence
  Synthetic oligonucleotide
tttaataagttcacctattg

SEQ ID NO: 1333 - DNA, 20 bp, Artificial sequence
  Synthetic oligonucleotide
atttaataagttcacctatt

SEQ ID NO: 1334 - DNA, 20 bp, Artificial sequence
  Synthetic oligonucleotide
tatttaataagttcacctat

SEQ ID NO: 1335 - DNA, 20 bp, Artificial sequence
  Synthetic oligonucleotide
ttatttaataagttcaccta

SEQ ID NO: 1336 - DNA, 20 bp, Artificial sequence
  Synthetic oligonucleotide
gttatttaataagttcacct

SEQ ID NO: 1337 - DNA, 20 bp, Artificial sequence
  Synthetic oligonucleotide
agttatttaataagttcacc

SEQ ID NO: 1338 - DNA, 20 bp, Artificial sequence
  Synthetic oligonucleotide
aaaagttatttaataagttc

SEQ ID NO: 1339 - DNA, 20 bp, Artificial sequence
  Synthetic oligonucleotide
tatttagaaaagttatttaa

SEQ ID NO: 1340 - DNA, 20 bp, Artificial sequence
  Synthetic oligonucleotide
taaaagtctctaaatttttt

SEQ ID NO: 1341 - DNA, 20 bp, Artificial sequence
  Synthetic oligonucleotide
ataaaagtctctaaattttt

SEQ ID NO: 1342 - DNA, 20 bp, Artificial sequence
  Synthetic oligonucleotide
aataaaagtctctaaatttt

SEQ ID NO: 1343 - DNA, 20 bp, Artificial sequence
  Synthetic oligonucleotide
ttagctcatatgatgccttt

SEQ ID NO: 1344 - DNA, 20 bp, Artificial sequence
  Synthetic oligonucleotide
attagctcatatgatgcctt

SEQ ID NO: 1345 - DNA, 20 bp, Artificial sequence
  Synthetic oligonucleotide
atattagctcatatgatgcc

SEQ ID NO: 1346 - DNA, 20 bp, Artificial sequence
  Synthetic oligonucleotide
gatattagctcatatgatgc

SEQ ID NO: 1347 - DNA, 20 bp, Artificial sequence
  Synthetic oligonucleotide
tgatattagctcatatgatg

SEQ ID NO: 1348 - DNA, 20 bp, Artificial sequence
  Synthetic oligonucleotide
gtgatattagctcatatgat

SEQ ID NO: 1349 - DNA, 20 bp, Artificial sequence
  Synthetic oligonucleotide
gaaagttgtgatattagctc

SEQ ID NO: 1350 - DNA, 20 bp, Artificial sequence
  Synthetic oligonucleotide
ggaaagttgtgatattagct

SEQ ID NO: 1351 - DNA, 20 bp, Artificial sequence
  Synthetic oligonucleotide
gggaaagttgtgatattagc

SEQ ID NO: 1352 - DNA, 20 bp, Artificial sequence
  Synthetic oligonucleotide
tgggaaagttgtgatattag

SEQ ID NO: 1353 - DNA, 20 bp, Artificial sequence
  Synthetic oligonucleotide
ctgggaaagttgtgatatta

SEQ ID NO: 1354 - DNA, 20 bp, Artificial sequence
  Synthetic oligonucleotide
actgggaaagttgtgatatt

SEQ ID NO: 1355 - DNA, 20 bp, Artificial sequence
  Synthetic oligonucleotide
aactgggaaagttgtgatat

SEQ ID NO: 1356 - DNA, 20 bp, Artificial sequence
  Synthetic oligonucleotide
aaactgggaaagttgtgata

SEQ ID NO: 1357 - DNA, 20 bp, Artificial sequence
  Synthetic oligonucleotide
taaactgggaaagttgtgat

SEQ ID NO: 1358 - DNA, 20 bp, Artificial sequence
  Synthetic oligonucleotide
ttaaactgggaaagttgtga

SEQ ID NO: 1359 - DNA, 20 bp, Artificial sequence
  Synthetic oligonucleotide
tttaaactgggaaagttgtg

SEQ ID NO: 1360 - DNA, 20 bp, Artificial sequence
  Synthetic oligonucleotide
ttttaaactgggaaagttgt

SEQ ID NO: 1361 - DNA, 20 bp, Artificial sequence
  Synthetic oligonucleotide
gttttttaaactgggaaagt

SEQ ID NO: 1362 - DNA, 20 bp, Artificial sequence
  Synthetic oligonucleotide
agttttttaaactgggaaag

SEQ ID NO: 1363 - DNA, 20 bp, Artificial sequence
  Synthetic oligonucleotide
tagttttttaaactgggaaa

SEQ ID NO: 1364 - DNA, 20 bp, Artificial sequence
  Synthetic oligonucleotide
gtactagttttttaaactgg

SEQ ID NO: 1365 - DNA, 20 bp, Artificial sequence
  Synthetic oligonucleotide
agagtactagttttttaaac

SEQ ID NO: 1366 - DNA, 20 bp, Artificial sequence
  Synthetic oligonucleotide
caagagtactagttttttaa

SEQ ID NO: 1367 - DNA, 20 bp, Artificial sequence
  Synthetic oligonucleotide
tttaacaagagtactagttt

SEQ ID NO: 1368 - DNA, 20 bp, Artificial sequence
  Synthetic oligonucleotide
ttttaacaagagtactagtt

SEQ ID NO: 1369 - DNA, 20 bp, Artificial sequence
  Synthetic oligonucleotide
gttttaacaagagtactagt

SEQ ID NO: 1370 - DNA, 20 bp, Artificial sequence
  Synthetic oligonucleotide
agttttaacaagagtactag

SEQ ID NO: 1371 - DNA, 20 bp, Artificial sequence
  Synthetic oligonucleotide
gagttttaacaagagtacta

SEQ ID NO: 1372 - DNA, 20 bp, Artificial sequence
  Synthetic oligonucleotide
agagttttaacaagagtact

SEQ ID NO: 1373 - DNA, 20 bp, Artificial sequence
  Synthetic oligonucleotide
tttagagttttaacaagagt

SEQ ID NO: 1374 - DNA, 20 bp, Artificial sequence
  Synthetic oligonucleotide
gtttagagttttaacaagag

SEQ ID NO: 1375 - DNA, 20 bp, Artificial sequence
  Synthetic oligonucleotide
aagtttagagttttaacaag

SEQ ID NO: 1376 - DNA, 20 bp, Artificial sequence
  Synthetic oligonucleotide
caagtttagagttttaacaa

SEQ ID NO: 1377 - DNA, 20 bp, Artificial sequence
  Synthetic oligonucleotide
tagtcaagtttagagtttta

SEQ ID NO: 1378 - DNA, 20 bp, Artificial sequence
  Synthetic oligonucleotide
ttagtcaagtttagagtttt

SEQ ID NO: 1379 - DNA, 20 bp, Artificial sequence
  Synthetic oligonucleotide
tttagtcaagtttagagttt

SEQ ID NO: 1380 - DNA, 20 bp, Artificial sequence
  Synthetic oligonucleotide
tgtatttagtcaagtttaga

SEQ ID NO: 1381 - DNA, 20 bp, Artificial sequence
  Synthetic oligonucleotide
ctgtatttagtcaagtttag

SEQ ID NO: 1382 - DNA, 20 bp, Artificial sequence
  Synthetic oligonucleotide
tctgtatttagtcaagttta

SEQ ID NO: 1383 - DNA, 20 bp, Artificial sequence
  Synthetic oligonucleotide
gtcctctgtatttagtcaag

SEQ ID NO: 1384 - DNA, 20 bp, Artificial sequence
  Synthetic oligonucleotide
agtcctctgtatttagtcaa

SEQ ID NO: 1385 - DNA, 20 bp, Artificial sequence
  Synthetic oligonucleotide
cagtcctctgtatttagtca

SEQ ID NO: 1386 - DNA, 20 bp, Artificial sequence
  Synthetic oligonucleotide
ccagtcctctgtatttagtc

SEQ ID NO: 1387 - DNA, 20 bp, Artificial sequence
  Synthetic oligonucleotide
accagtcctctgtatttagt

SEQ ID NO: 1388 - DNA, 20 bp, Artificial sequence
  Synthetic oligonucleotide
taccagtcctctgtatttag

SEQ ID NO: 1389 - DNA, 20 bp, Artificial sequence
  Synthetic oligonucleotide
ttaccagtcctctgtattta

SEQ ID NO: 1390 - DNA, 20 bp, Artificial sequence
  Synthetic oligonucleotide
attaccagtcctctgtattt

SEQ ID NO: 1391 - DNA, 20 bp, Artificial sequence
  Synthetic oligonucleotide
aattaccagtcctctgtatt

SEQ ID NO: 1392 - DNA, 20 bp, Artificial sequence
  Synthetic oligonucleotide
caattaccagtcctctgtat

SEQ ID NO: 1393 - DNA, 20 bp, Artificial sequence
  Synthetic oligonucleotide
acaattaccagtcctctgta

SEQ ID NO: 1394 - DNA, 20 bp, Artificial sequence
  Synthetic oligonucleotide
tacaattaccagtcctctgt

SEQ ID NO: 1395 - DNA, 20 bp, Artificial sequence
  Synthetic oligonucleotide
gtacaattaccagtcctctg

SEQ ID NO: 1396 - DNA, 20 bp, Artificial sequence
  Synthetic oligonucleotide
tgtacaattaccagtcctct

SEQ ID NO: 1397 - DNA, 20 bp, Artificial sequence
  Synthetic oligonucleotide
ctgtacaattaccagtcctc

SEQ ID NO: 1398 - DNA, 20 bp, Artificial sequence
  Synthetic oligonucleotide
actgtacaattaccagtcct

SEQ ID NO: 1399 - DNA, 20 bp, Artificial sequence
  Synthetic oligonucleotide
aactgtacaattaccagtcc

SEQ ID NO: 1400 - DNA, 20 bp, Artificial sequence
  Synthetic oligonucleotide
gaactgtacaattaccagtc

SEQ ID NO: 1401 - DNA, 20 bp, Artificial sequence
  Synthetic oligonucleotide
agaactgtacaattaccagt

SEQ ID NO: 1402 - DNA, 20 bp, Artificial sequence
  Synthetic oligonucleotide
taagaactgtacaattacca

SEQ ID NO: 1403 - DNA, 20 bp, Artificial sequence
  Synthetic oligonucleotide
ttaagaactgtacaattacc

SEQ ID NO: 1404 - DNA, 20 bp, Artificial sequence
  Synthetic oligonucleotide
tttaagaactgtacaattac

SEQ ID NO: 1405 - DNA, 20 bp, Artificial sequence
  Synthetic oligonucleotide
acttgaaattataataggaa

SEQ ID NO: 1406 - DNA, 20 bp, Artificial sequence
  Synthetic oligonucleotide
aaaaaactaacttgaaatta

SEQ ID NO: 1407 - DNA, 20 bp, Artificial sequence
  Synthetic oligonucleotide
gaaacaaaaaactaacttga

SEQ ID NO: 1408 - DNA, 20 bp, Artificial sequence
  Synthetic oligonucleotide
gtgttttcatatataacatt

SEQ ID NO: 1409 - DNA, 20 bp, Artificial sequence
  Synthetic oligonucleotide
aattttcagtgttttcatat

SEQ ID NO: 1410 - DNA, 20 bp, Artificial sequence
  Synthetic oligonucleotide
aaaatgcaaattttcagtgt

SEQ ID NO: 1411 - DNA, 20 bp, Artificial sequence
  Synthetic oligonucleotide
gtaattttcatataaaatgc

SEQ ID NO: 1412 - DNA, 20 bp, Artificial sequence
  Synthetic oligonucleotide
gatttgtaattttcatataa

SEQ ID NO: 1413 - DNA, 20 bp, Artificial sequence
  Synthetic oligonucleotide
taaccgatttgtaattttca

SEQ ID NO: 1414 - DNA, 20 bp, Artificial sequence
  Synthetic oligonucleotide
taatttaaccgatttgtaat

SEQ ID NO: 1415 - DNA, 20 bp, Artificial sequence
  Synthetic oligonucleotide
ttgtataatttaaccgattt

SEQ ID NO: 1416 - DNA, 20 bp, Artificial sequence
  Synthetic oligonucleotide
ctagattgtataatttaacc

SEQ ID NO: 1417 - DNA, 20 bp, Artificial sequence
  Synthetic oligonucleotide
gtgttctagattgtataatt

SEQ ID NO: 1418 - DNA, 20 bp, Artificial sequence
  Synthetic oligonucleotide
aatgacatagtgttctagat

SEQ ID NO: 1419 - DNA, 20 bp, Artificial sequence
  Synthetic oligonucleotide
agtgtaatgacatagtgttc

SEQ ID NO: 1420 - DNA, 20 bp, Artificial sequence
  Synthetic oligonucleotide
ttacaatagtgtaatgacat

SEQ ID NO: 1421 - DNA, 20 bp, Artificial sequence
  Synthetic oligonucleotide
ttcagtaatttacaatagtg

SEQ ID NO: 1422 - DNA, 20 bp, Artificial sequence
  Synthetic oligonucleotide
ttaccttcagtaatttacaa

SEQ ID NO: 1423 - DNA, 20 bp, Artificial sequence
  Synthetic oligonucleotide
ttaactttttacttaccttc

SEQ ID NO: 1424 - DNA, 20 bp, Artificial sequence
  Synthetic oligonucleotide
gaatagttttaaattttttt

SEQ ID NO: 1425 - DNA, 20 bp, Artificial sequence
  Synthetic oligonucleotide
acactggagaatagttttaa

SEQ ID NO: 1426 - DNA, 20 bp, Artificial sequence
  Synthetic oligonucleotide
tttaaacactggagaatagt

SEQ ID NO: 1427 - DNA, 20 bp, Artificial sequence
  Synthetic oligonucleotide
tctgttttaaacactggaga

SEQ ID NO: 1428 - DNA, 20 bp, Artificial sequence
  Synthetic oligonucleotide
gtattatttaatctgtttta

SEQ ID NO: 1429 - DNA, 20 bp, Artificial sequence
  Synthetic oligonucleotide
ttactgtattatttaatctg

SEQ ID NO: 1430 - DNA, 20 bp, Artificial sequence
  Synthetic oligonucleotide
taaatcttttccatttactg

SEQ ID NO: 1431 - DNA, 20 bp, Artificial sequence
  Synthetic oligonucleotide
atgaataaatcttttccatt

SEQ ID NO: 1432 - DNA, 20 bp, Artificial sequence
  Synthetic oligonucleotide
gcatattttcatatgaataa

SEQ ID NO: 1433 - DNA, 20 bp, Artificial sequence
  Synthetic oligonucleotide
gcccagcatattttcatatg

SEQ ID NO: 1434 - DNA, 20 bp, Artificial sequence
  Synthetic oligonucleotide
aaaagaaaaagcccagcata

SEQ ID NO: 1435 - DNA, 20 bp, Artificial sequence
  Synthetic oligonucleotide
ctgaacttcaattaaaagaa

SEQ ID NO: 1436 - DNA, 20 bp, Artificial sequence
  Synthetic oligonucleotide
gattttctgaacttcaatta

SEQ ID NO: 1437 - DNA, 20 bp, Artificial sequence
  Synthetic oligonucleotide
tctaaaatttgattttctga

SEQ ID NO: 1438 - DNA, 20 bp, Artificial sequence
  Synthetic oligonucleotide
actatctctaaaatttgatt

SEQ ID NO: 1439 - DNA, 20 bp, Artificial sequence
  Synthetic oligonucleotide
ttaaattgtactatctctaa

SEQ ID NO: 1440 - DNA, 20 bp, Artificial sequence
  Synthetic oligonucleotide
acattttatttaaattgtac

SEQ ID NO: 1441 - DNA, 20 bp, Artificial sequence
  Synthetic oligonucleotide
gtccttaacattttatttaa

SEQ ID NO: 1442 - DNA, 20 bp, Artificial sequence
  Synthetic oligonucleotide
catatttttgtccttaacat

SEQ ID NO: 1443 - DNA, 20 bp, Artificial sequence
  Synthetic oligonucleotide
tagcacatatttttgtcctt

SEQ ID NO: 1444 - DNA, 20 bp, Artificial sequence
  Synthetic oligonucleotide
tcaaatagcacatatttttg

SEQ ID NO: 1445 - DNA, 20 bp, Artificial sequence
  Synthetic oligonucleotide
cttctttcaaatagcacata

SEQ ID NO: 1446 - DNA, 20 bp, Artificial sequence
  Synthetic oligonucleotide
cttgtatgcttctttcaaat

SEQ ID NO: 1447 - DNA, 20 bp, Artificial sequence
  Synthetic oligonucleotide
attccttccccttgtatgct

SEQ ID NO: 1448 - DNA, 20 bp, Artificial sequence
  Synthetic oligonucleotide
ttggcaattccttccccttg

SEQ ID NO: 1449 - DNA, 20 bp, Artificial sequence
  Synthetic oligonucleotide
gaatattggcaattccttcc

SEQ ID NO: 1450 - DNA, 20 bp, Artificial sequence
  Synthetic oligonucleotide
tgaaaaatgaatattggcaa

SEQ ID NO: 1451 - DNA, 20 bp, Artificial sequence
  Synthetic oligonucleotide
taatggatttgaaaaatgaa

SEQ ID NO: 1452 - DNA, 20 bp, Artificial sequence
  Synthetic oligonucleotide
actaataatggatttgaaaa

SEQ ID NO: 1453 - DNA, 20 bp, Artificial sequence
  Synthetic oligonucleotide
cataatctaaatttttaaac

SEQ ID NO: 1454 - DNA, 20 bp, Artificial sequence
  Synthetic oligonucleotide
cactatcataatctaaattt

SEQ ID NO: 1455 - DNA, 20 bp, Artificial sequence
  Synthetic oligonucleotide
aatttcctgtaacactatca

SEQ ID NO: 1456 - DNA, 20 bp, Artificial sequence
  Synthetic oligonucleotide
ctattaatttcctgtaacac

SEQ ID NO: 1457 - DNA, 20 bp, Artificial sequence
  Synthetic oligonucleotide
cttttctattaatttcctgt

SEQ ID NO: 1458 - DNA, 20 bp, Artificial sequence
  Synthetic oligonucleotide
ctctttcttttctattaatt

SEQ ID NO: 1459 - DNA, 20 bp, Artificial sequence
  Synthetic oligonucleotide
agttgctttcctctttcttt

SEQ ID NO: 1460 - DNA, 20 bp, Artificial sequence
  Synthetic oligonucleotide
ttataagttgctttcctctt

SEQ ID NO: 1461 - DNA, 20 bp, Artificial sequence
  Synthetic oligonucleotide
gttggttataagttgctttc

SEQ ID NO: 1462 - DNA, 20 bp, Artificial sequence
  Synthetic oligonucleotide
agtaggttggttataagttg

SEQ ID NO: 1463 - DNA, 20 bp, Artificial sequence
  Synthetic oligonucleotide
tagagagtaggttggttata

SEQ ID NO: 1464 - DNA, 20 bp, Artificial sequence
  Synthetic oligonucleotide
ggatatagagagtaggttgg

SEQ ID NO: 1465 - DNA, 20 bp, Artificial sequence
  Synthetic oligonucleotide
agtctggatatagagagtag

SEQ ID NO: 1466 - DNA, 20 bp, Artificial sequence
  Synthetic oligonucleotide
tacaaaagtctggatataga

SEQ ID NO: 1467 - DNA, 20 bp, Artificial sequence
  Synthetic oligonucleotide
gtttttctacaaaagtctgg

SEQ ID NO: 1468 - DNA, 20 bp, Artificial sequence
  Synthetic oligonucleotide
ttacctgattttctatttct

SEQ ID NO: 1469 - DNA, 20 bp, Artificial sequence
  Synthetic oligonucleotide
atactgacttacctgatttt

SEQ ID NO: 1470 - DNA, 20 bp, Artificial sequence
  Synthetic oligonucleotide
ttaaaatactgacttacctg

SEQ ID NO: 1471 - DNA, 20 bp, Artificial sequence
  Synthetic oligonucleotide
taccattaaaatactgactt

SEQ ID NO: 1472 - DNA, 20 bp, Artificial sequence
  Synthetic oligonucleotide
ggacataccattaaaatact

SEQ ID NO: 1473 - DNA, 20 bp, Artificial sequence
  Synthetic oligonucleotide
aaagatgggacataccatta

SEQ ID NO: 1474 - DNA, 20 bp, Artificial sequence
  Synthetic oligonucleotide
agacctgtgtgaaagatggg

SEQ ID NO: 1475 - DNA, 20 bp, Artificial sequence
  Synthetic oligonucleotide
tttacagacctgtgtgaaag

SEQ ID NO: 1476 - DNA, 20 bp, Artificial sequence
  Synthetic oligonucleotide
gtgtttttacagacctgtgt

SEQ ID NO: 1477 - DNA, 20 bp, Artificial sequence
  Synthetic oligonucleotide
attcagtgtttttacagacc

SEQ ID NO: 1478 - DNA, 20 bp, Artificial sequence
  Synthetic oligonucleotide
ttaggattcagtgtttttac

SEQ ID NO: 1479 - DNA, 20 bp, Artificial sequence
  Synthetic oligonucleotide
ataattttaggattcagtgt

SEQ ID NO: 1480 - DNA, 20 bp, Artificial sequence
  Synthetic oligonucleotide
gcttgtaaataattttagga

SEQ ID NO: 1481 - DNA, 20 bp, Artificial sequence
  Synthetic oligonucleotide
gttaaagcttgtaaataatt

SEQ ID NO: 1482 - DNA, 20 bp, Artificial sequence
  Synthetic oligonucleotide
tgttttatatctcttgaaaa

SEQ ID NO: 1483 - DNA, 20 bp, Artificial sequence
  Synthetic oligonucleotide
ttggtaataatatttgtttt

SEQ ID NO: 1484 - DNA, 20 bp, Artificial sequence
  Synthetic oligonucleotide
ggaaattggtaataatattt

SEQ ID NO: 1485 - DNA, 20 bp, Artificial sequence
  Synthetic oligonucleotide
ttagtggaaattggtaataa

SEQ ID NO: 1486 - DNA, 20 bp, Artificial sequence
  Synthetic oligonucleotide
tttgtttagtggaaattggt

SEQ ID NO: 1487 - DNA, 20 bp, Artificial sequence
  Synthetic oligonucleotide
ttatgtttgtttagtggaaa

SEQ ID NO: 1488 - DNA, 20 bp, Artificial sequence
  Synthetic oligonucleotide
taacattatgtttgtttagt

SEQ ID NO: 1489 - DNA, 20 bp, Artificial sequence
  Synthetic oligonucleotide
actactaacattatgtttgt

SEQ ID NO: 1490 - DNA, 20 bp, Artificial sequence
  Synthetic oligonucleotide
gcagcactactaacattatg

SEQ ID NO: 1491 - DNA, 20 bp, Artificial sequence
  Synthetic oligonucleotide
ttttagcagcactactaaca

SEQ ID NO: 1492 - DNA, 20 bp, Artificial sequence
  Synthetic oligonucleotide
aaaccttttagcagcactac

SEQ ID NO: 1493 - DNA, 20 bp, Artificial sequence
  Synthetic oligonucleotide
gataaaaaaccttttagcag

SEQ ID NO: 1494 - DNA, 20 bp, Artificial sequence
  Synthetic oligonucleotide
tagttgataaaaaacctttt

SEQ ID NO: 1495 - DNA, 20 bp, Artificial sequence
  Synthetic oligonucleotide
caaaagtagttgataaaaaa

SEQ ID NO: 1496 - DNA, 20 bp, Artificial sequence
  Synthetic oligonucleotide
atggaaaccaaaagtagttg

SEQ ID NO: 1497 - DNA, 20 bp, Artificial sequence
  Synthetic oligonucleotide
aaagtatggaaaccaaaagt

SEQ ID NO: 1498 - DNA, 20 bp, Artificial sequence
  Synthetic oligonucleotide
gaaggaaagtatggaaacca

SEQ ID NO: 1499 - DNA, 20 bp, Artificial sequence
  Synthetic oligonucleotide
cataagaaggaaagtatgga

SEQ ID NO: 1500 - DNA, 20 bp, Artificial sequence
  Synthetic oligonucleotide
taacatcataagaaggaaag

SEQ ID NO: 1501 - DNA, 20 bp, Artificial sequence
  Synthetic oligonucleotide
gaataataacatcataagaa

SEQ ID NO: 1502 - DNA, 20 bp, Artificial sequence
  Synthetic oligonucleotide
gaatttagaataataacatc

SEQ ID NO: 1503 - DNA, 20 bp, Artificial sequence
  Synthetic oligonucleotide
tataattgaaaagaatttag

SEQ ID NO: 1504 - DNA, 20 bp, Artificial sequence
  Synthetic oligonucleotide
tagtaaaagatataattgaa

SEQ ID NO: 1505 - DNA, 20 bp, Artificial sequence
  Synthetic oligonucleotide
aatcatagtaaaagatataa

SEQ ID NO: 1506 - DNA, 20 bp, Artificial sequence
  Synthetic oligonucleotide
caggttcatttaatcatagt

SEQ ID NO: 1507 - DNA, 20 bp, Artificial sequence
  Synthetic oligonucleotide
ctatagtaacattttgcttt

SEQ ID NO: 1508 - DNA, 20 bp, Artificial sequence
  Synthetic oligonucleotide
gtatattactatagtaacat

SEQ ID NO: 1509 - DNA, 20 bp, Artificial sequence
  Synthetic oligonucleotide
acaatgtatattactatagt

SEQ ID NO: 1510 - DNA, 20 bp, Artificial sequence
  Synthetic oligonucleotide
tagacacaatgtatattact

SEQ ID NO: 1511 - DNA, 20 bp, Artificial sequence
  Synthetic oligonucleotide
tatttttagacacaatgtat

SEQ ID NO: 1512 - DNA, 20 bp, Artificial sequence
  Synthetic oligonucleotide
acacatttttatttttagac

SEQ ID NO: 1513 - DNA, 20 bp, Artificial sequence
  Synthetic oligonucleotide
ttggtttcttcacacatttt

SEQ ID NO: 1514 - DNA, 20 bp, Artificial sequence
  Synthetic oligonucleotide
ttcattgttttggtttcttc

SEQ ID NO: 1515 - DNA, 20 bp, Artificial sequence
  Synthetic oligonucleotide
cagaaattcattgttttggt

SEQ ID NO: 1516 - DNA, 20 bp, Artificial sequence
  Synthetic oligonucleotide
cttcttccaactcagaaatt

SEQ ID NO: 1517 - DNA, 20 bp, Artificial sequence
  Synthetic oligonucleotide
tgatctaactcttcttccaa

SEQ ID NO: 1518 - DNA, 20 bp, Artificial sequence
  Synthetic oligonucleotide
ttaaatgatctaactcttct

SEQ ID NO: 1519 - DNA, 20 bp, Artificial sequence
  Synthetic oligonucleotide
tgagaaagttaaatgatcta

SEQ ID NO: 1520 - DNA, 20 bp, Artificial sequence
  Synthetic oligonucleotide
tacttaaatttttagagttt

SEQ ID NO: 1521 - DNA, 20 bp, Artificial sequence
  Synthetic oligonucleotide
aaagttacttaaatttttag

SEQ ID NO: 1522 - DNA, 20 bp, Artificial sequence
  Synthetic oligonucleotide
atcttaaagttacttaaatt

SEQ ID NO: 1523 - DNA, 20 bp, Artificial sequence
  Synthetic oligonucleotide
atgtgatcttaaagttactt

SEQ ID NO: 1524 - DNA, 20 bp, Artificial sequence
  Synthetic oligonucleotide
taactatgtgatcttaaagt

SEQ ID NO: 1525 - DNA, 20 bp, Artificial sequence
  Synthetic oligonucleotide
ttactcttttctactaagta

SEQ ID NO: 1526 - DNA, 20 bp, Artificial sequence
  Synthetic oligonucleotide
gggtattactcttttctact

SEQ ID NO: 1527 - DNA, 20 bp, Artificial sequence
  Synthetic oligonucleotide
taaagtttgcttgctgggta

SEQ ID NO: 1528 - DNA, 20 bp, Artificial sequence
  Synthetic oligonucleotide
tattgtaaagtttgcttgct

SEQ ID NO: 1529 - DNA, 20 bp, Artificial sequence
  Synthetic oligonucleotide
taaaaggatctattgtaaag

SEQ ID NO: 1530 - DNA, 20 bp, Artificial sequence
  Synthetic oligonucleotide
ttatttaaaaggatctattg

SEQ ID NO: 1531 - DNA, 20 bp, Artificial sequence
  Synthetic oligonucleotide
ggaccttatttaaaaggatc

SEQ ID NO: 1532 - DNA, 20 bp, Artificial sequence
  Synthetic oligonucleotide
gatatttcctaggaccttat

SEQ ID NO: 1533 - DNA, 20 bp, Artificial sequence
  Synthetic oligonucleotide
tgaatgatatttcctaggac

SEQ ID NO: 1534 - DNA, 20 bp, Artificial sequence
  Synthetic oligonucleotide
gatgctggcatgaatgatat

SEQ ID NO: 1535 - DNA, 20 bp, Artificial sequence
  Synthetic oligonucleotide
ttttttgatgctggcatgaa

SEQ ID NO: 1536 - DNA, 20 bp, Artificial sequence
  Synthetic oligonucleotide
gttagttttttgatgctggc

SEQ ID NO: 1537 - DNA, 20 bp, Artificial sequence
  Synthetic oligonucleotide
ttagtgttagttttttgatg

SEQ ID NO: 1538 - DNA, 20 bp, Artificial sequence
  Synthetic oligonucleotide
gcattattagtgttagtttt

SEQ ID NO: 1539 - DNA, 20 bp, Artificial sequence
  Synthetic oligonucleotide
atcttgcattattagtgtta

SEQ ID NO: 1540 - DNA, 20 bp, Artificial sequence
  Synthetic oligonucleotide
ataatatcttgcattattag

SEQ ID NO: 1541 - DNA, 20 bp, Artificial sequence
  Synthetic oligonucleotide
cagtaagaaaagcagaatat

SEQ ID NO: 1542 - DNA, 20 bp, Artificial sequence
  Synthetic oligonucleotide
tcattgacagtaagaaaagc

SEQ ID NO: 1543 - DNA, 20 bp, Artificial sequence
  Synthetic oligonucleotide
gatagtttttctcattgaca

SEQ ID NO: 1544 - DNA, 20 bp, Artificial sequence
  Synthetic oligonucleotide
gtttgcaatttattgaatga

SEQ ID NO: 1545 - DNA, 20 bp, Artificial sequence
  Synthetic oligonucleotide
gtgttgggtttgcaatttat

SEQ ID NO: 1546 - DNA, 20 bp, Artificial sequence
  Synthetic oligonucleotide
ttaagtgtgttgggtttgca

SEQ ID NO: 1547 - DNA, 20 bp, Artificial sequence
  Synthetic oligonucleotide
ttttatttaagtgtgttggg

SEQ ID NO: 1548 - DNA, 20 bp, Artificial sequence
  Synthetic oligonucleotide
tttagcagtaacattttatt

SEQ ID NO: 1549 - DNA, 20 bp, Artificial sequence
  Synthetic oligonucleotide
gttagtttagcagtaacatt

SEQ ID NO: 1550 - DNA, 20 bp, Artificial sequence
  Synthetic oligonucleotide
tctatatattcagtagttta

SEQ ID NO: 1551 - DNA, 20 bp, Artificial sequence
  Synthetic oligonucleotide
ttactttctatatattcagt

SEQ ID NO: 1552 - DNA, 20 bp, Artificial sequence
  Synthetic oligonucleotide
gtttgcttactttctatata

SEQ ID NO: 1553 - DNA, 20 bp, Artificial sequence
  Synthetic oligonucleotide
agtttgtttgcttactttct

SEQ ID NO: 1554 - DNA, 20 bp, Artificial sequence
  Synthetic oligonucleotide
tggcaagtttgtttgcttac

SEQ ID NO: 1555 - DNA, 20 bp, Artificial sequence
  Synthetic oligonucleotide
ttactgttactgtatttccc

SEQ ID NO: 1556 - DNA, 20 bp, Artificial sequence
  Synthetic oligonucleotide
atgtagttactgttactgta

SEQ ID NO: 1557 - DNA, 20 bp, Artificial sequence
  Synthetic oligonucleotide
atgcaatttaatgggtacag

SEQ ID NO: 1558 - DNA, 20 bp, Artificial sequence
  Synthetic oligonucleotide
tagatatgcaatttaatggg

SEQ ID NO: 1559 - DNA, 20 bp, Artificial sequence
  Synthetic oligonucleotide
aggagatagatatgcaattt

SEQ ID NO: 1560 - DNA, 20 bp, Artificial sequence
  Synthetic oligonucleotide
cctaaaggagatagatatgc

SEQ ID NO: 1561 - DNA, 20 bp, Artificial sequence
  Synthetic oligonucleotide
agcctcctaaaggagataga

SEQ ID NO: 1562 - DNA, 20 bp, Artificial sequence
  Synthetic oligonucleotide
caccaccagcctcctaaagg

SEQ ID NO: 1563 - DNA, 20 bp, Artificial sequence
  Synthetic oligonucleotide
atctaagaaaattaataaac

SEQ ID NO: 1564 - DNA, 20 bp, Artificial sequence
  Synthetic oligonucleotide
atgatcacatctaagaaaat

SEQ ID NO: 1565 - DNA, 20 bp, Artificial sequence
  Synthetic oligonucleotide
aactgcaataccatgatcac

SEQ ID NO: 1566 - DNA, 20 bp, Artificial sequence
  Synthetic oligonucleotide
taaaactgcaataccatgat

SEQ ID NO: 1567 - DNA, 20 bp, Artificial sequence
  Synthetic oligonucleotide
ctttaaaactgcaataccat

SEQ ID NO: 1568 - DNA, 20 bp, Artificial sequence
  Synthetic oligonucleotide
tctcctttaaaactgcaata

SEQ ID NO: 1569 - DNA, 20 bp, Artificial sequence
  Synthetic oligonucleotide
tgttctcctttaaaactgca

SEQ ID NO: 1570 - DNA, 20 bp, Artificial sequence
  Synthetic oligonucleotide
gattgttctcctttaaaact

SEQ ID NO: 1571 - DNA, 20 bp, Artificial sequence
  Synthetic oligonucleotide
aggagattgttctcctttaa

SEQ ID NO: 1572 - DNA, 20 bp, Artificial sequence
  Synthetic oligonucleotide
aacaggagattgttctcctt

SEQ ID NO: 1573 - DNA, 20 bp, Artificial sequence
  Synthetic oligonucleotide
ttaaacaggagattgttctc

SEQ ID NO: 1574 - DNA, 20 bp, Artificial sequence
  Synthetic oligonucleotide
ctcttaaacaggagattgtt

SEQ ID NO: 1575 - DNA, 20 bp, Artificial sequence
  Synthetic oligonucleotide
ctttaactccgtaaatattt

SEQ ID NO: 1576 - DNA, 20 bp, Artificial sequence
  Synthetic oligonucleotide
agtgacctttaactccgtaa

SEQ ID NO: 1577 - DNA, 20 bp, Artificial sequence
  Synthetic oligonucleotide
ggagtccagtgacctttaac

SEQ ID NO: 1578 - DNA, 20 bp, Artificial sequence
  Synthetic oligonucleotide
accagtctggagtccagtga

SEQ ID NO: 1579 - DNA, 20 bp, Artificial sequence
  Synthetic oligonucleotide
tcatcttaccaaactatttt

SEQ ID NO: 1580 - DNA, 20 bp, Artificial sequence
  Synthetic oligonucleotide
gaatcatcttaccaaactat

SEQ ID NO: 1581 - DNA, 20 bp, Artificial sequence
  Synthetic oligonucleotide
taagaatcatcttaccaaac

SEQ ID NO: 1582 - DNA, 20 bp, Artificial sequence
  Synthetic oligonucleotide
aagaatgtaagaatcatctt

SEQ ID NO: 1583 - DNA, 20 bp, Artificial sequence
  Synthetic oligonucleotide
gttatttaagaatgtaagaa

SEQ ID NO: 1584 - DNA, 20 bp, Artificial sequence
  Synthetic oligonucleotide
cgtgttatttaagaatgtaa

SEQ ID NO: 1585 - DNA, 20 bp, Artificial sequence
  Synthetic oligonucleotide
taaagcatttttcttagatg

SEQ ID NO: 1586 - DNA, 20 bp, Artificial sequence
  Synthetic oligonucleotide
tgttaaagcatttttcttag

SEQ ID NO: 1587 - DNA, 20 bp, Artificial sequence
  Synthetic oligonucleotide
tttatgttaaagcatttttc

SEQ ID NO: 1588 - DNA, 20 bp, Artificial sequence
  Synthetic oligonucleotide
atgtttatgttaaagcattt

SEQ ID NO: 1589 - DNA, 20 bp, Artificial sequence
  Synthetic oligonucleotide
gcattttttcagtaatgttt

SEQ ID NO: 1590 - DNA, 20 bp, Artificial sequence
  Synthetic oligonucleotide
tgtagcattttttcagtaat

SEQ ID NO: 1591 - DNA, 20 bp, Artificial sequence
  Synthetic oligonucleotide
caaatgtagcattttttcag

SEQ ID NO: 1592 - DNA, 20 bp, Artificial sequence
  Synthetic oligonucleotide
aagttgtggcaaatgtagca

SEQ ID NO: 1593 - DNA, 20 bp, Artificial sequence
  Synthetic oligonucleotide
atgaagttgtggcaaatgta

SEQ ID NO: 1594 - DNA, 20 bp, Artificial sequence
  Synthetic oligonucleotide
tttatgaagttgtggcaaat

SEQ ID NO: 1595 - DNA, 20 bp, Artificial sequence
  Synthetic oligonucleotide
tgacattttatgaagttgtg

SEQ ID NO: 1596 - DNA, 20 bp, Artificial sequence
  Synthetic oligonucleotide
cttgagatttcacttgacat

SEQ ID NO: 1597 - DNA, 20 bp, Artificial sequence
  Synthetic oligonucleotide
tttggagcttgagatttcac

SEQ ID NO: 1598 - DNA, 20 bp, Artificial sequence
  Synthetic oligonucleotide
atctttggagcttgagattt

SEQ ID NO: 1599 - DNA, 20 bp, Artificial sequence
  Synthetic oligonucleotide
aatatctttggagcttgaga

SEQ ID NO: 1600 - DNA, 20 bp, Artificial sequence
  Synthetic oligonucleotide
aataatatctttggagcttg

SEQ ID NO: 1601 - DNA, 20 bp, Artificial sequence
  Synthetic oligonucleotide
aggaataatatctttggagc

SEQ ID NO: 1602 - DNA, 20 bp, Artificial sequence
  Synthetic oligonucleotide
aataggaataatatctttgg

SEQ ID NO: 1603 - DNA, 20 bp, Artificial sequence
  Synthetic oligonucleotide
agtaataggaataatatctt

SEQ ID NO: 1604 - DNA, 20 bp, Artificial sequence
  Synthetic oligonucleotide
ttacatcagatttagtaata

SEQ ID NO: 1605 - DNA, 20 bp, Artificial sequence
  Synthetic oligonucleotide
aaatgttattacatcagatt

SEQ ID NO: 1606 - DNA, 20 bp, Artificial sequence
  Synthetic oligonucleotide
ataaaatgttattacatcag

SEQ ID NO: 1607 - DNA, 20 bp, Artificial sequence
  Synthetic oligonucleotide
cctagaatcaataaaatgtt

SEQ ID NO: 1608 - DNA, 20 bp, Artificial sequence
  Synthetic oligonucleotide
aggaatgcctagaatcaata

SEQ ID NO: 1609 - DNA, 20 bp, Artificial sequence
  Synthetic oligonucleotide
attcagcaggaatgcctaga

SEQ ID NO: 1610 - DNA, 20 bp, Artificial sequence
  Synthetic oligonucleotide
tacattcagcaggaatgcct

SEQ ID NO: 1611 - DNA, 20 bp, Artificial sequence
  Synthetic oligonucleotide
ttacctgatataacatcaca

SEQ ID NO: 1612 - DNA, 20 bp, Artificial sequence
  Synthetic oligonucleotide
gttttacctgatataacatc

SEQ ID NO: 1613 - DNA, 20 bp, Artificial sequence
  Synthetic oligonucleotide
caggttttacctgatataac

SEQ ID NO: 1614 - DNA, 20 bp, Artificial sequence
  Synthetic oligonucleotide
ttagacaggttttacctgat

SEQ ID NO: 1615 - DNA, 20 bp, Artificial sequence
  Synthetic oligonucleotide
attctccttagacaggtttt

SEQ ID NO: 1616 - DNA, 20 bp, Artificial sequence
  Synthetic oligonucleotide
actgtctattctccttagac

SEQ ID NO: 1617 - DNA, 20 bp, Artificial sequence
  Synthetic oligonucleotide
actactgtctattctcctta

SEQ ID NO: 1618 - DNA, 20 bp, Artificial sequence
  Synthetic oligonucleotide
actaactactgtctattctc

SEQ ID NO: 1619 - DNA, 20 bp, Artificial sequence
  Synthetic oligonucleotide
tgaactaactactgtctatt

SEQ ID NO: 1620 - DNA, 20 bp, Artificial sequence
  Synthetic oligonucleotide
agttgaactaactactgtct

SEQ ID NO: 1621 - DNA, 20 bp, Artificial sequence
  Synthetic oligonucleotide
attaattgatatgtaaaacg

SEQ ID NO: 1622 - DNA, 20 bp, Artificial sequence
  Synthetic oligonucleotide
ccaattaattgatatgtaaa

SEQ ID NO: 1623 - DNA, 20 bp, Artificial sequence
  Synthetic oligonucleotide
tccttttaacttccaattaa

SEQ ID NO: 1624 - DNA, 20 bp, Artificial sequence
  Synthetic oligonucleotide
gtttcctggtccttttaact

SEQ ID NO: 1625 - DNA, 20 bp, Artificial sequence
  Synthetic oligonucleotide
tctgagtttcctggtccttt

SEQ ID NO: 1626 - DNA, 20 bp, Artificial sequence
  Synthetic oligonucleotide
atgtctgagtttcctggtcc

SEQ ID NO: 1627 - DNA, 20 bp, Artificial sequence
  Synthetic oligonucleotide
tgtatgtctgagtttcctgg

SEQ ID NO: 1628 - DNA, 20 bp, Artificial sequence
  Synthetic oligonucleotide
atgtatactgtatgtctgag

SEQ ID NO: 1629 - DNA, 20 bp, Artificial sequence
  Synthetic oligonucleotide
aaaatgtatactgtatgtct

SEQ ID NO: 1630 - DNA, 20 bp, Artificial sequence
  Synthetic oligonucleotide
ttttaaaatgtatactgtat

SEQ ID NO: 1631 - DNA, 20 bp, Artificial sequence
  Synthetic oligonucleotide
catacattctatatattata

SEQ ID NO: 1632 - DNA, 20 bp, Artificial sequence
  Synthetic oligonucleotide
attataagccatacattcta

SEQ ID NO: 1633 - DNA, 20 bp, Artificial sequence
  Synthetic oligonucleotide
ttcattataagccatacatt

SEQ ID NO: 1634 - DNA, 20 bp, Artificial sequence
  Synthetic oligonucleotide
taattcattataagccatac

SEQ ID NO: 1635 - DNA, 20 bp, Artificial sequence
  Synthetic oligonucleotide
tgagttaactaattcattat

SEQ ID NO: 1636 - DNA, 20 bp, Artificial sequence
  Synthetic oligonucleotide
tttgcattgagttaactaat

SEQ ID NO: 1637 - DNA, 20 bp, Artificial sequence
  Synthetic oligonucleotide
taatttgcattgagttaact

SEQ ID NO: 1638 - DNA, 20 bp, Artificial sequence
  Synthetic oligonucleotide
gaataatttgcattgagtta

SEQ ID NO: 1639 - DNA, 20 bp, Artificial sequence
  Synthetic oligonucleotide
atagaataatttgcattgag

SEQ ID NO: 1640 - DNA, 20 bp, Artificial sequence
  Synthetic oligonucleotide
aaaatagaataatttgcatt

SEQ ID NO: 1641 - DNA, 20 bp, Artificial sequence
  Synthetic oligonucleotide
ttgtaatcaaaatagaataa

SEQ ID NO: 1642 - DNA, 20 bp, Artificial sequence
  Synthetic oligonucleotide
tatttgtaatcaaaatagaa

SEQ ID NO: 1643 - DNA, 20 bp, Artificial sequence
  Synthetic oligonucleotide
tactatttgtaatcaaaata

SEQ ID NO: 1644 - DNA, 20 bp, Artificial sequence
  Synthetic oligonucleotide
ttttactatttgtaatcaaa

SEQ ID NO: 1645 - DNA, 20 bp, Artificial sequence
  Synthetic oligonucleotide
gcttattttactatttgtaa

SEQ ID NO: 1646 - DNA, 20 bp, Artificial sequence
  Synthetic oligonucleotide
cttgcttattttactatttg

SEQ ID NO: 1647 - DNA, 20 bp, Artificial sequence
  Synthetic oligonucleotide
ttatcttgcttattttacta

SEQ ID NO: 1648 - DNA, 20 bp, Artificial sequence
  Synthetic oligonucleotide
gttattttatcttgcttatt

SEQ ID NO: 1649 - DNA, 20 bp, Artificial sequence
  Synthetic oligonucleotide
aaacatctgttattttatct

SEQ ID NO: 1650 - DNA, 20 bp, Artificial sequence
  Synthetic oligonucleotide
ggattttaaacatctgttat

SEQ ID NO: 1651 - DNA, 20 bp, Artificial sequence
  Synthetic oligonucleotide
ctttttggattttaaacatc

SEQ ID NO: 1652 - DNA, 20 bp, Artificial sequence
  Synthetic oligonucleotide
gtgctttttggattttaaac

SEQ ID NO: 1653 - DNA, 20 bp, Artificial sequence
  Synthetic oligonucleotide
ttttgtatgtgctttttgga

SEQ ID NO: 1654 - DNA, 20 bp, Artificial sequence
  Synthetic oligonucleotide
taagtgagtacttagacatc

SEQ ID NO: 1655 - DNA, 20 bp, Artificial sequence
  Synthetic oligonucleotide
tactttataagtgagtactt

SEQ ID NO: 1656 - DNA, 20 bp, Artificial sequence
  Synthetic oligonucleotide
ttctactttataagtgagta

SEQ ID NO: 1657 - DNA, 20 bp, Artificial sequence
  Synthetic oligonucleotide
aatgtcttctactttataag

SEQ ID NO: 1658 - DNA, 20 bp, Artificial sequence
  Synthetic oligonucleotide
aataatgaatgtcttctact

SEQ ID NO: 1659 - DNA, 20 bp, Artificial sequence
  Synthetic oligonucleotide
tataataatgaatgtcttct

SEQ ID NO: 1660 - DNA, 20 bp, Artificial sequence
  Synthetic oligonucleotide
tgatataataatgaatgtct

SEQ ID NO: 1661 - DNA, 20 bp, Artificial sequence
  Synthetic oligonucleotide
aaaatttgatataataatga

SEQ ID NO: 1662 - DNA, 20 bp, Artificial sequence
  Synthetic oligonucleotide
catttaaaaatttgatataa

SEQ ID NO: 1663 - DNA, 20 bp, Artificial sequence
  Synthetic oligonucleotide
gtactgagcatttaaaaatt

SEQ ID NO: 1664 - DNA, 20 bp, Artificial sequence
  Synthetic oligonucleotide
aatggtcaaatagtactgag

SEQ ID NO: 1665 - DNA, 20 bp, Artificial sequence
  Synthetic oligonucleotide
ttaaatggtcaaatagtact

SEQ ID NO: 1666 - DNA, 20 bp, Artificial sequence
  Synthetic oligonucleotide
agtttgaatacaaaattttt

SEQ ID NO: 1667 - DNA, 20 bp, Artificial sequence
  Synthetic oligonucleotide
actggtagtttgaatacaaa

SEQ ID NO: 1668 - DNA, 20 bp, Artificial sequence
  Synthetic oligonucleotide
ttcactggtagtttgaatac

SEQ ID NO: 1669 - DNA, 20 bp, Artificial sequence
  Synthetic oligonucleotide
gctttcactggtagtttgaa

SEQ ID NO: 1670 - DNA, 20 bp, Artificial sequence
  Synthetic oligonucleotide
agggctttcactggtagttt

SEQ ID NO: 1671 - DNA, 20 bp, Artificial sequence
  Synthetic oligonucleotide
ggtagggctttcactggtag

SEQ ID NO: 1672 - DNA, 20 bp, Artificial sequence
  Synthetic oligonucleotide
ctaggtagggctttcactgg

SEQ ID NO: 1673 - DNA, 20 bp, Artificial sequence
  Synthetic oligonucleotide
cttctaggtagggctttcac

SEQ ID NO: 1674 - DNA, 20 bp, Artificial sequence
  Synthetic oligonucleotide
taccttctaggtagggcttt

SEQ ID NO: 1675 - DNA, 20 bp, Artificial sequence
  Synthetic oligonucleotide
gtataccttctaggtagggc

SEQ ID NO: 1676 - DNA, 20 bp, Artificial sequence
  Synthetic oligonucleotide
tgagtataccttctaggtag

SEQ ID NO: 1677 - DNA, 20 bp, Artificial sequence
  Synthetic oligonucleotide
cactgagtataccttctagg

SEQ ID NO: 1678 - DNA, 20 bp, Artificial sequence
  Synthetic oligonucleotide
tatcactgagtataccttct

SEQ ID NO: 1679 - DNA, 20 bp, Artificial sequence
  Synthetic oligonucleotide
acttatcactgagtatacct

SEQ ID NO: 1680 - DNA, 20 bp, Artificial sequence
  Synthetic oligonucleotide
acaaaacttatcactgagta

SEQ ID NO: 1681 - DNA, 20 bp, Artificial sequence
  Synthetic oligonucleotide
gctacaaaacttatcactga

SEQ ID NO: 1682 - DNA, 20 bp, Artificial sequence
  Synthetic oligonucleotide
ggagctacaaaacttatcac

SEQ ID NO: 1683 - DNA, 20 bp, Artificial sequence
  Synthetic oligonucleotide
gatttggagctacaaaactt

SEQ ID NO: 1684 - DNA, 20 bp, Artificial sequence
  Synthetic oligonucleotide
gaagatttggagctacaaaa

SEQ ID NO: 1685 - DNA, 20 bp, Artificial sequence
  Synthetic oligonucleotide
ctattagaagatttggagct

SEQ ID NO: 1686 - DNA, 20 bp, Artificial sequence
  Synthetic oligonucleotide
cactcactattagaagattt

SEQ ID NO: 1687 - DNA, 20 bp, Artificial sequence
  Synthetic oligonucleotide
tgtcagccttttattttggg

SEQ ID NO: 1688 - DNA, 20 bp, Artificial sequence
  Synthetic oligonucleotide
acctgtcagccttttatttt

SEQ ID NO: 1689 - DNA, 20 bp, Artificial sequence
  Synthetic oligonucleotide
tcgacttacctgtcagcctt

SEQ ID NO: 1690 - DNA, 20 bp, Artificial sequence
  Synthetic oligonucleotide
ttctcgacttacctgtcagc

SEQ ID NO: 1691 - DNA, 20 bp, Artificial sequence
  Synthetic oligonucleotide
gtattctcgacttacctgtc

SEQ ID NO: 1692 - DNA, 20 bp, Artificial sequence
  Synthetic oligonucleotide
taacatccatatacagtcaa

SEQ ID NO: 1693 - DNA, 20 bp, Artificial sequence
  Synthetic oligonucleotide
tattaacatccatatacagt

SEQ ID NO: 1694 - DNA, 20 bp, Artificial sequence
  Synthetic oligonucleotide
atttattaacatccatatac

SEQ ID NO: 1695 - DNA, 20 bp, Artificial sequence
  Synthetic oligonucleotide
gctatttattaacatccata

SEQ ID NO: 1696 - DNA, 20 bp, Artificial sequence
  Synthetic oligonucleotide
ctgtcagctatttattaaca

SEQ ID NO: 1697 - DNA, 20 bp, Artificial sequence
  Synthetic oligonucleotide
ttactgtcagctatttatta

SEQ ID NO: 1698 - DNA, 20 bp, Artificial sequence
  Synthetic oligonucleotide
actttactgtcagctattta

SEQ ID NO: 1699 - DNA, 20 bp, Artificial sequence
  Synthetic oligonucleotide
taaactttactgtcagctat

SEQ ID NO: 1700 - DNA, 20 bp, Artificial sequence
  Synthetic oligonucleotide
ggataaactttactgtcagc

SEQ ID NO: 1701 - DNA, 20 bp, Artificial sequence
  Synthetic oligonucleotide
tatggataaactttactgtc

SEQ ID NO: 1702 - DNA, 20 bp, Artificial sequence
  Synthetic oligonucleotide
ttatatggataaactttact

SEQ ID NO: 1703 - DNA, 20 bp, Artificial sequence
  Synthetic oligonucleotide
ttgcaagtctttatatggat

SEQ ID NO: 1704 - DNA, 20 bp, Artificial sequence
  Synthetic oligonucleotide
tatttgcaagtctttatatg

SEQ ID NO: 1705 - DNA, 20 bp, Artificial sequence
  Synthetic oligonucleotide
gaatatttgcaagtctttat

SEQ ID NO: 1706 - DNA, 20 bp, Artificial sequence
  Synthetic oligonucleotide
gtagaggaatatttgcaagt

SEQ ID NO: 1707 - DNA, 20 bp, Artificial sequence
  Synthetic oligonucleotide
gttacattattatagatatt

SEQ ID NO: 1708 - DNA, 20 bp, Artificial sequence
  Synthetic oligonucleotide
tgtgttacattattatagat

SEQ ID NO: 1709 - DNA, 20 bp, Artificial sequence
  Synthetic oligonucleotide
gaaatgtgttacattattat

SEQ ID NO: 1710 - DNA, 20 bp, Artificial sequence
  Synthetic oligonucleotide
ttcaccagtgaaatgtgtta

SEQ ID NO: 1711 - DNA, 20 bp, Artificial sequence
  Synthetic oligonucleotide
tgtttcaccagtgaaatgtg

SEQ ID NO: 1712 - DNA, 20 bp, Artificial sequence
  Synthetic oligonucleotide
acatgtttcaccagtgaaat

SEQ ID NO: 1713 - DNA, 20 bp, Artificial sequence
  Synthetic oligonucleotide
aagacatgtttcaccagtga

SEQ ID NO: 1714 - DNA, 20 bp, Artificial sequence
  Synthetic oligonucleotide
gacaagacatgtttcaccag

SEQ ID NO: 1715 - DNA, 20 bp, Artificial sequence
  Synthetic oligonucleotide
tatgacaagacatgtttcac

SEQ ID NO: 1716 - DNA, 20 bp, Artificial sequence
  Synthetic oligonucleotide
gcatatgacaagacatgttt

SEQ ID NO: 1717 - DNA, 20 bp, Artificial sequence
  Synthetic oligonucleotide
taatgcatatgacaagacat

SEQ ID NO: 1718 - DNA, 20 bp, Artificial sequence
  Synthetic oligonucleotide
ctataatgcatatgacaaga

SEQ ID NO: 1719 - DNA, 20 bp, Artificial sequence
  Synthetic oligonucleotide
tttctataatgcatatgaca

SEQ ID NO: 1720 - DNA, 20 bp, Artificial sequence
  Synthetic oligonucleotide
tcctttctataatgcatatg

SEQ ID NO: 1721 - DNA, 20 bp, Artificial sequence
  Synthetic oligonucleotide
tctgattatcctttctataa

SEQ ID NO: 1722 - DNA, 20 bp, Artificial sequence
  Synthetic oligonucleotide
aagtctgattatcctttcta

SEQ ID NO: 1723 - DNA, 20 bp, Artificial sequence
  Synthetic oligonucleotide
aactgaaagtctgattatcc

SEQ ID NO: 1724 - DNA, 20 bp, Artificial sequence
  Synthetic oligonucleotide
tataactgaaagtctgatta

SEQ ID NO: 1725 - DNA, 20 bp, Artificial sequence
  Synthetic oligonucleotide
gttaaaaatattaatataac

SEQ ID NO: 1726 - DNA, 20 bp, Artificial sequence
  Synthetic oligonucleotide
tgtgcacaaaaatgttaaaa

SEQ ID NO: 1727 - DNA, 20 bp, Artificial sequence
  Synthetic oligonucleotide
ctatgtgcacaaaaatgtta

SEQ ID NO: 1728 - DNA, 20 bp, Artificial sequence
  Synthetic oligonucleotide
tagctatgtgcacaaaaatg

SEQ ID NO: 1729 - DNA, 20 bp, Artificial sequence
  Synthetic oligonucleotide
agatagctatgtgcacaaaa

SEQ ID NO: 1730 - DNA, 20 bp, Artificial sequence
  Synthetic oligonucleotide
tgaagatagctatgtgcaca

SEQ ID NO: 1731 - DNA, 20 bp, Artificial sequence
  Synthetic oligonucleotide
tattgaagatagctatgtgc

SEQ ID NO: 1732 - DNA, 20 bp, Artificial sequence
  Synthetic oligonucleotide
ttttattgaagatagctatg

SEQ ID NO: 1733 - DNA, 20 bp, Artificial sequence
  Synthetic oligonucleotide
caattttattgaagatagct

SEQ ID NO: 1734 - DNA, 20 bp, Artificial sequence
  Synthetic oligonucleotide
aaacaattttattgaagata

SEQ ID NO: 1735 - DNA, 20 bp, Artificial sequence
  Synthetic oligonucleotide
gtgtatcttaaaataatacc

SEQ ID NO: 1736 - DNA, 20 bp, Artificial sequence
  Synthetic oligonucleotide
ttagtgtatcttaaaataat

SEQ ID NO: 1737 - DNA, 20 bp, Artificial sequence
  Synthetic oligonucleotide
tgatcattttagtgtatctt

SEQ ID NO: 1738 - DNA, 20 bp, Artificial sequence
  Synthetic oligonucleotide
cccttgatcattttagtgta

SEQ ID NO: 1739 - DNA, 20 bp, Artificial sequence
  Synthetic oligonucleotide
aatcccttgatcattttagt

SEQ ID NO: 1740 - DNA, 20 bp, Artificial sequence
  Synthetic oligonucleotide
ttgaatcccttgatcatttt

SEQ ID NO: 1741 - DNA, 20 bp, Artificial sequence
  Synthetic oligonucleotide
ttagtcttgaatcccttgat

SEQ ID NO: 1742 - DNA, 20 bp, Artificial sequence
  Synthetic oligonucleotide
ttgtttagtcttgaatccct

SEQ ID NO: 1743 - DNA, 20 bp, Artificial sequence
  Synthetic oligonucleotide
gagttgtttagtcttgaatc

SEQ ID NO: 1744 - DNA, 20 bp, Artificial sequence
  Synthetic oligonucleotide
attgagttgtttagtcttga

SEQ ID NO: 1745 - DNA, 20 bp, Artificial sequence
  Synthetic oligonucleotide
ctaattgagttgtttagtct

SEQ ID NO: 1746 - DNA, 20 bp, Artificial sequence
  Synthetic oligonucleotide
caactaattgagttgtttag

SEQ ID NO: 1747 - DNA, 20 bp, Artificial sequence
  Synthetic oligonucleotide
attggtgcaactaattgagt

SEQ ID NO: 1748 - DNA, 20 bp, Artificial sequence
  Synthetic oligonucleotide
tttattggtgcaactaattg

SEQ ID NO: 1749 - DNA, 20 bp, Artificial sequence
  Synthetic oligonucleotide
ttttttattggtgcaactaa

SEQ ID NO: 1750 - DNA, 20 bp, Artificial sequence
  Synthetic oligonucleotide
taagtgttttttattggtgc

SEQ ID NO: 1751 - DNA, 20 bp, Artificial sequence
  Synthetic oligonucleotide
actgacagtttttttaagtg

SEQ ID NO: 1752 - DNA, 20 bp, Artificial sequence
  Synthetic oligonucleotide
gacactgacagtttttttaa

SEQ ID NO: 1753 - DNA, 20 bp, Artificial sequence
  Synthetic oligonucleotide
ttggacactgacagtttttt

SEQ ID NO: 1754 - DNA, 20 bp, Artificial sequence
  Synthetic oligonucleotide
aggttggacactgacagttt

SEQ ID NO: 1755 - DNA, 20 bp, Artificial sequence
  Synthetic oligonucleotide
tacaggttggacactgacag

SEQ ID NO: 1756 - DNA, 20 bp, Artificial sequence
  Synthetic oligonucleotide
tatattggataatttgaaat

SEQ ID NO: 1757 - DNA, 20 bp, Artificial sequence
  Synthetic oligonucleotide
atgtatattggataatttga

SEQ ID NO: 1758 - DNA, 20 bp, Artificial sequence
  Synthetic oligonucleotide
gacatgtatattggataatt

SEQ ID NO: 1759 - DNA, 20 bp, Artificial sequence
  Synthetic oligonucleotide
atgacatgtatattggataa

SEQ ID NO: 1760 - DNA, 20 bp, Artificial sequence
  Synthetic oligonucleotide
tatatatgacatgtatattg

SEQ ID NO: 1761 - DNA, 20 bp, Artificial sequence
  Synthetic oligonucleotide
atgtgacatataaaaatata

SEQ ID NO: 1762 - DNA, 20 bp, Artificial sequence
  Synthetic oligonucleotide
atatgtgacatataaaaata

SEQ ID NO: 1763 - DNA, 20 bp, Artificial sequence
  Synthetic oligonucleotide
tttatatatgtgacatataa

SEQ ID NO: 1764 - DNA, 20 bp, Artificial sequence
  Synthetic oligonucleotide
cttttatatatgtgacatat

SEQ ID NO: 1765 - DNA, 20 bp, Artificial sequence
  Synthetic oligonucleotide
atcttttatatatgtgacat

SEQ ID NO: 1766 - DNA, 20 bp, Artificial sequence
  Synthetic oligonucleotide
catatcttttatatatgtga

SEQ ID NO: 1767 - DNA, 20 bp, Artificial sequence
  Synthetic oligonucleotide
tcatacatatcttttatata

SEQ ID NO: 1768 - DNA, 20 bp, Artificial sequence
  Synthetic oligonucleotide
tagatcatacatatctttta

SEQ ID NO: 1769 - DNA, 20 bp, Artificial sequence
  Synthetic oligonucleotide
catagatcatacatatcttt

SEQ ID NO: 1770 - DNA, 20 bp, Artificial sequence
  Synthetic oligonucleotide
cacatagatcatacatatct

SEQ ID NO: 1771 - DNA, 20 bp, Artificial sequence
  Synthetic oligonucleotide
aggattcacatagatcatac

SEQ ID NO: 1772 - DNA, 20 bp, Artificial sequence
  Synthetic oligonucleotide
ttaggattcacatagatcat

SEQ ID NO: 1773 - DNA, 20 bp, Artificial sequence
  Synthetic oligonucleotide
acttaggattcacatagatc

SEQ ID NO: 1774 - DNA, 20 bp, Artificial sequence
  Synthetic oligonucleotide
ttacttaggattcacataga

SEQ ID NO: 1775 - DNA, 20 bp, Artificial sequence
  Synthetic oligonucleotide
tatttacttaggattcacat

SEQ ID NO: 1776 - DNA, 20 bp, Artificial sequence
  Synthetic oligonucleotide
aatatttacttaggattcac

SEQ ID NO: 1777 - DNA, 20 bp, Artificial sequence
  Synthetic oligonucleotide
tgtacttttctggaacaaaa

SEQ ID NO: 1778 - DNA, 20 bp, Artificial sequence
  Synthetic oligonucleotide
gattatttttacctttatta

SEQ ID NO: 1779 - DNA, 20 bp, Artificial sequence
  Synthetic oligonucleotide
tagattatttttacctttat

SEQ ID NO: 1780 - DNA, 20 bp, Artificial sequence
  Synthetic oligonucleotide
attatagattatttttacct

SEQ ID NO: 1781 - DNA, 20 bp, Artificial sequence
  Synthetic oligonucleotide
gaaaattatagattattttt

SEQ ID NO: 1782 - DNA, 20 bp, Artificial sequence
  Synthetic oligonucleotide
ggtcctgaaaattatagatt

SEQ ID NO: 1783 - DNA, 20 bp, Artificial sequence
  Synthetic oligonucleotide
gtggtcctgaaaattataga

SEQ ID NO: 1784 - DNA, 20 bp, Artificial sequence
  Synthetic oligonucleotide
ctgtggtcctgaaaattata

SEQ ID NO: 1785 - DNA, 20 bp, Artificial sequence
  Synthetic oligonucleotide
gtctgtggtcctgaaaatta

SEQ ID NO: 1786 - DNA, 20 bp, Artificial sequence
  Synthetic oligonucleotide
tcgacagcttagtctgtggt

SEQ ID NO: 1787 - DNA, 20 bp, Artificial sequence
  Synthetic oligonucleotide
tttcgacagcttagtctgtg

SEQ ID NO: 1788 - DNA, 20 bp, Artificial sequence
  Synthetic oligonucleotide
aatttcgacagcttagtctg

SEQ ID NO: 1789 - DNA, 20 bp, Artificial sequence
  Synthetic oligonucleotide
ttaatttcgacagcttagtc

SEQ ID NO: 1790 - DNA, 20 bp, Artificial sequence
  Synthetic oligonucleotide
cgttaatttcgacagcttag

SEQ ID NO: 1791 - DNA, 20 bp, Artificial sequence
  Synthetic oligonucleotide
tggccctaaaaaaatcagcg

SEQ ID NO: 1792 - DNA, 20 bp, Artificial sequence
  Synthetic oligonucleotide
tctggccctaaaaaaatcag

SEQ ID NO: 1793 - DNA, 20 bp, Artificial sequence
  Synthetic oligonucleotide
tggtattctggccctaaaaa

SEQ ID NO: 1794 - DNA, 20 bp, Artificial sequence
  Synthetic oligonucleotide
tttggtattctggccctaaa

SEQ ID NO: 1795 - DNA, 20 bp, Artificial sequence
  Synthetic oligonucleotide
ccattttggtattctggccc

SEQ ID NO: 1796 - DNA, 20 bp, Artificial sequence
  Synthetic oligonucleotide
gaggagccattttggtattc

SEQ ID NO: 1797 - DNA, 20 bp, Artificial sequence
  Synthetic oligonucleotide
gagaggagccattttggtat

SEQ ID NO: 1798 - DNA, 20 bp, Artificial sequence
  Synthetic oligonucleotide
aagagaggagccattttggt

SEQ ID NO: 1799 - DNA, 20 bp, Artificial sequence
  Synthetic oligonucleotide
tgaaattgtccaattttggg

SEQ ID NO: 1800 - DNA, 20 bp, Artificial sequence
  Synthetic oligonucleotide
tttgaaattgtccaattttg

SEQ ID NO: 1801 - DNA, 20 bp, Artificial sequence
  Synthetic oligonucleotide
catttgaaattgtccaattt

SEQ ID NO: 1802 - DNA, 20 bp, Artificial sequence
  Synthetic oligonucleotide
tgcatttgaaattgtccaat

SEQ ID NO: 1803 - DNA, 20 bp, Artificial sequence
  Synthetic oligonucleotide
attttgcatttgaaattgtc

SEQ ID NO: 1804 - DNA, 20 bp, Artificial sequence
  Synthetic oligonucleotide
ataatgaattattttgcatt

SEQ ID NO: 1805 - DNA, 20 bp, Artificial sequence
  Synthetic oligonucleotide
taaataatgaattattttgc

SEQ ID NO: 1806 - DNA, 20 bp, Artificial sequence
  Synthetic oligonucleotide
ctcatatattaaataatgaa

SEQ ID NO: 1807 - DNA, 20 bp, Artificial sequence
  Synthetic oligonucleotide
aactcatatattaaataatg

SEQ ID NO: 1808 - DNA, 20 bp, Artificial sequence
  Synthetic oligonucleotide
tagaggaagcaactcatata

SEQ ID NO: 1809 - DNA, 20 bp, Artificial sequence
  Synthetic oligonucleotide
aatagaggaagcaactcata

SEQ ID NO: 1810 - DNA, 20 bp, Artificial sequence
  Synthetic oligonucleotide
caaatagaggaagcaactca

SEQ ID NO: 1811 - DNA, 20 bp, Artificial sequence
  Synthetic oligonucleotide
accaaatagaggaagcaact

SEQ ID NO: 1812 - DNA, 20 bp, Artificial sequence
  Synthetic oligonucleotide
aaaccaaatagaggaagcaa

SEQ ID NO: 1813 - DNA, 20 bp, Artificial sequence
  Synthetic oligonucleotide
ggaaaccaaatagaggaagc

SEQ ID NO: 1814 - DNA, 20 bp, Artificial sequence
  Synthetic oligonucleotide
taaggaaaccaaatagagga

SEQ ID NO: 1815 - DNA, 20 bp, Artificial sequence
  Synthetic oligonucleotide
tttaaggaaaccaaatagag

SEQ ID NO: 1816 - DNA, 20 bp, Artificial sequence
  Synthetic oligonucleotide
tgttttcttctggaagcaga

SEQ ID NO: 1817 - DNA, 20 bp, Artificial sequence
  Synthetic oligonucleotide
cttactttaagtgaagttac

SEQ ID NO: 1818 - DNA, 20 bp, Artificial sequence
  Synthetic oligonucleotide
ttttctacttactttaagtg

SEQ ID NO: 1819 - DNA, 20 bp, Artificial sequence
  Synthetic oligonucleotide
acatgaaccctctttatttt

SEQ ID NO: 1820 - DNA, 20 bp, Artificial sequence
  Synthetic oligonucleotide
gaaaacataaacatgaaccc

SEQ ID NO: 1821 - DNA, 20 bp, Artificial sequence
  Synthetic oligonucleotide
agatccacattgaaaacata

SEQ ID NO: 1822 - DNA, 20 bp, Artificial sequence
  Synthetic oligonucleotide
ttaaaagatccacattgaaa

SEQ ID NO: 1823 - DNA, 20 bp, Artificial sequence
  Synthetic oligonucleotide
gccttagaaatatttttttt

SEQ ID NO: 1824 - DNA, 20 bp, Artificial sequence
  Synthetic oligonucleotide
caaatggcatgccttagaaa

SEQ ID NO: 1825 - DNA, 20 bp, Artificial sequence
  Synthetic oligonucleotide
tatttcaaatggcatgcctt

SEQ ID NO: 1826 - DNA, 20 bp, Artificial sequence
  Synthetic oligonucleotide
caaagtatttcaaatggcat

SEQ ID NO: 1827 - DNA, 20 bp, Artificial sequence
  Synthetic oligonucleotide
tgcaacaaagtatttcaaat

SEQ ID NO: 1828 - DNA, 20 bp, Artificial sequence
  Synthetic oligonucleotide
tcaacaatgcaacaaagtat

SEQ ID NO: 1829 - DNA, 20 bp, Artificial sequence
  Synthetic oligonucleotide
gaaaaaaaagtatttcaaca

SEQ ID NO: 1830 - DNA, 20 bp, Artificial sequence
  Synthetic oligonucleotide
gattatttttcttggaaaaa

SEQ ID NO: 1831 - DNA, 20 bp, Artificial sequence
  Synthetic oligonucleotide
gaaattttattttctggaga

SEQ ID NO: 1832 - DNA, 20 bp, Artificial sequence
  Synthetic oligonucleotide
aaattataataggaaatttt

SEQ ID NO: 1833 - DNA, 20 bp, Artificial sequence
  Synthetic oligonucleotide
ctgaatataatgaatgaaat

SEQ ID NO: 1834 - DNA, 20 bp, Artificial sequence
  Synthetic oligonucleotide
tacctgaatataatgaatga

SEQ ID NO: 1835 - DNA, 20 bp, Artificial sequence
  Synthetic oligonucleotide
gactacctgaatataatgaa

SEQ ID NO: 1836 - DNA, 20 bp, Artificial sequence
  Synthetic oligonucleotide
atggactacctgaatataat

SEQ ID NO: 1837 - DNA, 20 bp, Artificial sequence
  Synthetic oligonucleotide
tccatggactacctgaatat

SEQ ID NO: 1838 - DNA, 20 bp, Artificial sequence
  Synthetic oligonucleotide
accatcaagcctcccaaaac

SEQ ID NO: 1839 - DNA, 20 bp, Artificial sequence
  Synthetic oligonucleotide
ccttaccatcaagcctccca

SEQ ID NO: 1840 - DNA, 20 bp, Artificial sequence
  Synthetic oligonucleotide
agtccccttaccatcaagcc

SEQ ID NO: 1841 - DNA, 20 bp, Artificial sequence
  Synthetic oligonucleotide
tgtagtccccttaccatcaa

SEQ ID NO: 1842 - DNA, 20 bp, Artificial sequence
  Synthetic oligonucleotide
gaatgtagtccccttaccat

SEQ ID NO: 1843 - DNA, 20 bp, Artificial sequence
  Synthetic oligonucleotide
attgaatgtagtccccttac

SEQ ID NO: 1844 - DNA, 20 bp, Artificial sequence
  Synthetic oligonucleotide
atgattgaatgtagtcccct

SEQ ID NO: 1845 - DNA, 20 bp, Artificial sequence
  Synthetic oligonucleotide
gattagcaagtgaatgaatg

SEQ ID NO: 1846 - DNA, 20 bp, Artificial sequence
  Synthetic oligonucleotide
gtagattagcaagtgaatga

SEQ ID NO: 1847 - DNA, 20 bp, Artificial sequence
  Synthetic oligonucleotide
tttgtagattagcaagtgaa

SEQ ID NO: 1848 - DNA, 20 bp, Artificial sequence
  Synthetic oligonucleotide
atatttgtagattagcaagt

SEQ ID NO: 1849 - DNA, 20 bp, Artificial sequence
  Synthetic oligonucleotide
ccataagaggttctcagtaa

SEQ ID NO: 1850 - DNA, 20 bp, Artificial sequence
  Synthetic oligonucleotide
ggtccataagaggttctcag

SEQ ID NO: 1851 - DNA, 20 bp, Artificial sequence
  Synthetic oligonucleotide
cctggtccataagaggttct

SEQ ID NO: 1852 - DNA, 20 bp, Artificial sequence
  Synthetic oligonucleotide
taatacctggtccataagag

SEQ ID NO: 1853 - DNA, 20 bp, Artificial sequence
  Synthetic oligonucleotide
tcctaatacctggtccataa

SEQ ID NO: 1854 - DNA, 20 bp, Artificial sequence
  Synthetic oligonucleotide
ttttcctaatacctggtcca

SEQ ID NO: 1855 - DNA, 20 bp, Artificial sequence
  Synthetic oligonucleotide
tacttttcctaatacctggt

SEQ ID NO: 1856 - DNA, 20 bp, Artificial sequence
  Synthetic oligonucleotide
cgttactacttttcctaata

SEQ ID NO: 1857 - DNA, 20 bp, Artificial sequence
  Synthetic oligonucleotide
aaggctgagactgcttctcg

SEQ ID NO: 1858 - DNA, 20 bp, Artificial sequence
  Synthetic oligonucleotide
gataataaattatatgaagg

SEQ ID NO: 1859 - DNA, 20 bp, Artificial sequence
  Synthetic oligonucleotide
gtttgataataaattatatg

SEQ ID NO: 1860 - DNA, 20 bp, Artificial sequence
  Synthetic oligonucleotide
gtgtaattgtttgataataa

SEQ ID NO: 1861 - DNA, 20 bp, Artificial sequence
  Synthetic oligonucleotide
aatgtgtaattgtttgataa

SEQ ID NO: 1862 - DNA, 20 bp, Artificial sequence
  Synthetic oligonucleotide
gtaatttactaacaaatgtg

SEQ ID NO: 1863 - DNA, 20 bp, Artificial sequence
  Synthetic oligonucleotide
agtgtaatttactaacaaat

SEQ ID NO: 1864 - DNA, 20 bp, Artificial sequence
  Synthetic oligonucleotide
ataagtgtaatttactaaca

SEQ ID NO: 1865 - DNA, 20 bp, Artificial sequence
  Synthetic oligonucleotide
gtaataagtgtaatttacta

SEQ ID NO: 1866 - DNA, 20 bp, Artificial sequence
  Synthetic oligonucleotide
gttgtaataagtgtaattta

SEQ ID NO: 1867 - DNA, 20 bp, Artificial sequence
  Synthetic oligonucleotide
acagttgtaataagtgtaat

SEQ ID NO: 1868 - DNA, 20 bp, Artificial sequence
  Synthetic oligonucleotide
ataacagttgtaataagtgt

SEQ ID NO: 1869 - DNA, 20 bp, Artificial sequence
  Synthetic oligonucleotide
ttcaaataataacagttgta

SEQ ID NO: 1870 - DNA, 20 bp, Artificial sequence
  Synthetic oligonucleotide
ataattcaaataataacagt

SEQ ID NO: 1871 - DNA, 20 bp, Artificial sequence
  Synthetic oligonucleotide
aattgtgataaatataattc

SEQ ID NO: 1872 - DNA, 20 bp, Artificial sequence
  Synthetic oligonucleotide
atgtaattgtgataaatata

SEQ ID NO: 1873 - DNA, 20 bp, Artificial sequence
  Synthetic oligonucleotide
gacatgtaattgtgataaat

SEQ ID NO: 1874 - DNA, 20 bp, Artificial sequence
  Synthetic oligonucleotide
acagacatgtaattgtgata

SEQ ID NO: 1875 - DNA, 20 bp, Artificial sequence
  Synthetic oligonucleotide
agaacagacatgtaattgtg

SEQ ID NO: 1876 - DNA, 20 bp, Artificial sequence
  Synthetic oligonucleotide
ttaagaacagacatgtaatt

SEQ ID NO: 1877 - DNA, 20 bp, Artificial sequence
  Synthetic oligonucleotide
aagtatatttaagaacagac

SEQ ID NO: 1878 - DNA, 20 bp, Artificial sequence
  Synthetic oligonucleotide
ttaaattgtgataagtatat

SEQ ID NO: 1879 - DNA, 20 bp, Artificial sequence
  Synthetic oligonucleotide
gaattaaattgtgataagta

SEQ ID NO: 1880 - DNA, 20 bp, Artificial sequence
  Synthetic oligonucleotide
gtggaattaaattgtgataa

SEQ ID NO: 1881 - DNA, 20 bp, Artificial sequence
  Synthetic oligonucleotide
gccgtggaattaaattgtga

SEQ ID NO: 1882 - DNA, 20 bp, Artificial sequence
  Synthetic oligonucleotide
taagccgtggaattaaattg

SEQ ID NO: 1883 - DNA, 20 bp, Artificial sequence
  Synthetic oligonucleotide
ttgtaagccgtggaattaaa

SEQ ID NO: 1884 - DNA, 20 bp, Artificial sequence
  Synthetic oligonucleotide
tcattgtaagccgtggaatt

SEQ ID NO: 1885 - DNA, 20 bp, Artificial sequence
  Synthetic oligonucleotide
tgatcattgtaagccgtgga

SEQ ID NO: 1886 - DNA, 20 bp, Artificial sequence
  Synthetic oligonucleotide
tatagttatgatcattgtaa

SEQ ID NO: 1887 - DNA, 20 bp, Artificial sequence
  Synthetic oligonucleotide
aattatagttatgatcattg

SEQ ID NO: 1888 - DNA, 20 bp, Artificial sequence
  Synthetic oligonucleotide
ctttaataattatagttatg

SEQ ID NO: 1889 - DNA, 20 bp, Artificial sequence
  Synthetic oligonucleotide
tgtctttaataattatagtt

SEQ ID NO: 1890 - DNA, 20 bp, Artificial sequence
  Synthetic oligonucleotide
aattgtctttaataattata

SEQ ID NO: 1891 - DNA, 20 bp, Artificial sequence
  Synthetic oligonucleotide
tcaaaattgtctttaataat

SEQ ID NO: 1892 - DNA, 20 bp, Artificial sequence
  Synthetic oligonucleotide
atttaatcaaaattgtcttt

SEQ ID NO: 1893 - DNA, 20 bp, Artificial sequence
  Synthetic oligonucleotide
taacatttaatcaaaattgt

SEQ ID NO: 1894 - DNA, 20 bp, Artificial sequence
  Synthetic oligonucleotide
acataacatttaatcaaaat

SEQ ID NO: 1895 - DNA, 20 bp, Artificial sequence
  Synthetic oligonucleotide
atgacataacatttaatcaa

SEQ ID NO: 1896 - DNA, 20 bp, Artificial sequence
  Synthetic oligonucleotide
tacttatgacataacattta

SEQ ID NO: 1897 - DNA, 20 bp, Artificial sequence
  Synthetic oligonucleotide
ttactacttatgacataaca

SEQ ID NO: 1898 - DNA, 20 bp, Artificial sequence
  Synthetic oligonucleotide
aacagttactacttatgaca

SEQ ID NO: 1899 - DNA, 20 bp, Artificial sequence
  Synthetic oligonucleotide
tgtaacagttactacttatg

SEQ ID NO: 1900 - DNA, 20 bp, Artificial sequence
  Synthetic oligonucleotide
cttatttgtaacagttacta

SEQ ID NO: 1901 - DNA, 20 bp, Artificial sequence
  Synthetic oligonucleotide
tttcacagcttatttgtaac

SEQ ID NO: 1902 - DNA, 20 bp, Artificial sequence
  Synthetic oligonucleotide
tcttttcacagcttatttgt

SEQ ID NO: 1903 - DNA, 20 bp, Artificial sequence
  Synthetic oligonucleotide
ggttcttttcacagcttatt

SEQ ID NO: 1904 - DNA, 20 bp, Artificial sequence
  Synthetic oligonucleotide
ctaggagtggttcttttcac

SEQ ID NO: 1905 - DNA, 20 bp, Artificial sequence
  Synthetic oligonucleotide
atgctaggagtggttctttt

SEQ ID NO: 1906 - DNA, 20 bp, Artificial sequence
  Synthetic oligonucleotide
ctaatgctaggagtggttct

SEQ ID NO: 1907 - DNA, 20 bp, Artificial sequence
  Synthetic oligonucleotide
agagtgactaatgctaggag

SEQ ID NO: 1908 - DNA, 20 bp, Artificial sequence
  Synthetic oligonucleotide
agagaatagagtgactaatg

SEQ ID NO: 1909 - DNA, 20 bp, Artificial sequence
  Synthetic oligonucleotide
ttaatgagagaatagagtga

SEQ ID NO: 1910 - DNA, 20 bp, Artificial sequence
  Synthetic oligonucleotide
ctgttggtttaattgtttat

SEQ ID NO: 1911 - DNA, 20 bp, Artificial sequence
  Synthetic oligonucleotide
tgctgttggtttaattgttt

SEQ ID NO: 1912 - DNA, 20 bp, Artificial sequence
  Synthetic oligonucleotide
tatgctgttggtttaattgt

SEQ ID NO: 1913 - DNA, 20 bp, Artificial sequence
  Synthetic oligonucleotide
actatgctgttggtttaatt

SEQ ID NO: 1914 - DNA, 20 bp, Artificial sequence
  Synthetic oligonucleotide
tgactatgctgttggtttaa

SEQ ID NO: 1915 - DNA, 20 bp, Artificial sequence
  Synthetic oligonucleotide
atttgactatgctgttggtt

SEQ ID NO: 1916 - DNA, 20 bp, Artificial sequence
  Synthetic oligonucleotide
ttatttgactatgctgttgg

SEQ ID NO: 1917 - DNA, 20 bp, Artificial sequence
  Synthetic oligonucleotide
ttttatttgactatgctgtt

SEQ ID NO: 1918 - DNA, 20 bp, Artificial sequence
  Synthetic oligonucleotide
tcttttatttgactatgctg

SEQ ID NO: 1919 - DNA, 20 bp, Artificial sequence
  Synthetic oligonucleotide
tttcttttatttgactatgc

SEQ ID NO: 1920 - DNA, 20 bp, Artificial sequence
  Synthetic oligonucleotide
cttctgagctgattttctat

SEQ ID NO: 1921 - DNA, 20 bp, Artificial sequence
  Synthetic oligonucleotide
tccttctgagctgattttct

SEQ ID NO: 1922 - DNA, 20 bp, Artificial sequence
  Synthetic oligonucleotide
agtccttctgagctgatttt

SEQ ID NO: 1923 - DNA, 20 bp, Artificial sequence
  Synthetic oligonucleotide
ctagtccttctgagctgatt

SEQ ID NO: 1924 - DNA, 20 bp, Artificial sequence
  Synthetic oligonucleotide
tactagtccttctgagctga

SEQ ID NO: 1925 - DNA, 20 bp, Artificial sequence
  Synthetic oligonucleotide
aatactagtccttctgagct

SEQ ID NO: 1926 - DNA, 20 bp, Artificial sequence
  Synthetic oligonucleotide
tgaatactagtccttctgag

SEQ ID NO: 1927 - DNA, 20 bp, Artificial sequence
  Synthetic oligonucleotide
cttgaatactagtccttctg

SEQ ID NO: 1928 - DNA, 20 bp, Artificial sequence
  Synthetic oligonucleotide
ttcttgaatactagtccttc

SEQ ID NO: 1929 - DNA, 20 bp, Artificial sequence
  Synthetic oligonucleotide
tgggttcttgaatactagtc

SEQ ID NO: 1930 - DNA, 20 bp, Artificial sequence
  Synthetic oligonucleotide
tgtgggttcttgaatactag

SEQ ID NO: 1931 - DNA, 20 bp, Artificial sequence
  Synthetic oligonucleotide
tctgtgggttcttgaatact

SEQ ID NO: 1932 - DNA, 20 bp, Artificial sequence
  Synthetic oligonucleotide
tagagaaatttctgtgggtt

SEQ ID NO: 1933 - DNA, 20 bp, Artificial sequence
  Synthetic oligonucleotide
aagatagagaaatttctgtg

SEQ ID NO: 1934 - DNA, 20 bp, Artificial sequence
  Synthetic oligonucleotide
ggaagatagagaaatttctg

SEQ ID NO: 1935 - DNA, 20 bp, Artificial sequence
  Synthetic oligonucleotide
cttggcttggaagatagaga

SEQ ID NO: 1936 - DNA, 20 bp, Artificial sequence
  Synthetic oligonucleotide
ctcttggcttggaagataga

SEQ ID NO: 1937 - DNA, 20 bp, Artificial sequence
  Synthetic oligonucleotide
aagggagtagttcttggtgc

SEQ ID NO: 1938 - DNA, 20 bp, Artificial sequence
  Synthetic oligonucleotide
aaagggagtagttcttggtg

SEQ ID NO: 1939 - DNA, 20 bp, Artificial sequence
  Synthetic oligonucleotide
gaaagggagtagttcttggt

SEQ ID NO: 1940 - DNA, 20 bp, Artificial sequence
  Synthetic oligonucleotide
agaaagggagtagttcttgg

SEQ ID NO: 1941 - DNA, 20 bp, Artificial sequence
  Synthetic oligonucleotide
aagaaagggagtagttcttg

SEQ ID NO: 1942 - DNA, 20 bp, Artificial sequence
  Synthetic oligonucleotide
gaagaaagggagtagttctt

SEQ ID NO: 1943 - DNA, 20 bp, Artificial sequence
  Synthetic oligonucleotide
tcaactgaagaaagggagta

SEQ ID NO: 1944 - DNA, 20 bp, Artificial sequence
  Synthetic oligonucleotide
attcaactgaagaaagggag

SEQ ID NO: 1945 - DNA, 20 bp, Artificial sequence
  Synthetic oligonucleotide
cattcaactgaagaaaggga

SEQ ID NO: 1946 - DNA, 20 bp, Artificial sequence
  Synthetic oligonucleotide
tcattcaactgaagaaaggg

SEQ ID NO: 1947 - DNA, 20 bp, Artificial sequence
  Synthetic oligonucleotide
tttcattcaactgaagaaag

SEQ ID NO: 1948 - DNA, 20 bp, Artificial sequence
  Synthetic oligonucleotide
atttcattcaactgaagaaa

SEQ ID NO: 1949 - DNA, 20 bp, Artificial sequence
  Synthetic oligonucleotide
tatttcattcaactgaagaa

SEQ ID NO: 1950 - DNA, 20 bp, Artificial sequence
  Synthetic oligonucleotide
ttatttcattcaactgaaga

SEQ ID NO: 1951 - DNA, 20 bp, Artificial sequence
  Synthetic oligonucleotide
cttatttcattcaactgaag

SEQ ID NO: 1952 - DNA, 20 bp, Artificial sequence
  Synthetic oligonucleotide
tcttatttcattcaactgaa

SEQ ID NO: 1953 - DNA, 20 bp, Artificial sequence
  Synthetic oligonucleotide
ttcttatttcattcaactga

SEQ ID NO: 1954 - DNA, 20 bp, Artificial sequence
  Synthetic oligonucleotide
atttcttatttcattcaact

SEQ ID NO: 1955 - DNA, 20 bp, Artificial sequence
  Synthetic oligonucleotide
tacatttcttatttcattca

SEQ ID NO: 1956 - DNA, 20 bp, Artificial sequence
  Synthetic oligonucleotide
ttcagcaggaatgccatcat

SEQ ID NO: 1957 - DNA, 20 bp, Artificial sequence
  Synthetic oligonucleotide
attcagcaggaatgccatca

SEQ ID NO: 1958 - DNA, 20 bp, Artificial sequence
  Synthetic oligonucleotide
cattcagcaggaatgccatc

SEQ ID NO: 1959 - DNA, 20 bp, Artificial sequence
  Synthetic oligonucleotide
acattcagcaggaatgccat

SEQ ID NO: 1960 - DNA, 20 bp, Artificial sequence
  Synthetic oligonucleotide
tacattcagcaggaatgcca

SEQ ID NO: 1961 - DNA, 20 bp, Artificial sequence
  Synthetic oligonucleotide
gtacattcagcaggaatgcc

SEQ ID NO: 1962 - DNA, 20 bp, Artificial sequence
  Synthetic oligonucleotide
tggtacattcagcaggaatg

SEQ ID NO: 1963 - DNA, 20 bp, Artificial sequence
  Synthetic oligonucleotide
gtggtacattcagcaggaat

SEQ ID NO: 1964 - DNA, 20 bp, Artificial sequence
  Synthetic oligonucleotide
ggtggtacattcagcaggaa

SEQ ID NO: 1965 - DNA, 20 bp, Artificial sequence
  Synthetic oligonucleotide
tggtggtacattcagcagga

SEQ ID NO: 1966 - DNA, 20 bp, Artificial sequence
  Synthetic oligonucleotide
atggtggtacattcagcagg

SEQ ID NO: 1967 - DNA, 20 bp, Artificial sequence
  Synthetic oligonucleotide
aatggtggtacattcagcag

SEQ ID NO: 1968 - DNA, 20 bp, Artificial sequence
  Synthetic oligonucleotide
aaatggtggtacattcagca

SEQ ID NO: 1969 - DNA, 20 bp, Artificial sequence
  Synthetic oligonucleotide
taaatggtggtacattcagc

SEQ ID NO: 1970 - DNA, 20 bp, Artificial sequence
  Synthetic oligonucleotide
tataaatggtggtacattca

SEQ ID NO: 1971 - DNA, 20 bp, Artificial sequence
  Synthetic oligonucleotide
ttataaatggtggtacattc

SEQ ID NO: 1972 - DNA, 20 bp, Artificial sequence
  Synthetic oligonucleotide
gttataaatggtggtacatt

SEQ ID NO: 1973 - DNA, 20 bp, Artificial sequence
  Synthetic oligonucleotide
tgttataaatggtggtacat

SEQ ID NO: 1974 - DNA, 20 bp, Artificial sequence
  Synthetic oligonucleotide
ctgttataaatggtggtaca

SEQ ID NO: 1975 - DNA, 20 bp, Artificial sequence
  Synthetic oligonucleotide
tctgttataaatggtggtac

SEQ ID NO: 1976 - DNA, 20 bp, Artificial sequence
  Synthetic oligonucleotide
cacctctgttataaatggtg

SEQ ID NO: 1977 - DNA, 20 bp, Artificial sequence
  Synthetic oligonucleotide
tcacctctgttataaatggt

SEQ ID NO: 1978 - DNA, 20 bp, Artificial sequence
  Synthetic oligonucleotide
ttcacctctgttataaatgg

SEQ ID NO: 1979 - DNA, 20 bp, Artificial sequence
  Synthetic oligonucleotide
gttcacctctgttataaatg

SEQ ID NO: 1980 - DNA, 20 bp, Artificial sequence
  Synthetic oligonucleotide
atgttcacctctgttataaa

SEQ ID NO: 1981 - DNA, 20 bp, Artificial sequence
  Synthetic oligonucleotide
tatgttcacctctgttataa

SEQ ID NO: 1982 - DNA, 20 bp, Artificial sequence
  Synthetic oligonucleotide
gtatgttcacctctgttata

SEQ ID NO: 1983 - DNA, 20 bp, Artificial sequence
  Synthetic oligonucleotide
tgtatgttcacctctgttat

SEQ ID NO: 1984 - DNA, 20 bp, Artificial sequence
  Synthetic oligonucleotide
taatcgcaactagatgtagc

SEQ ID NO: 1985 - DNA, 20 bp, Artificial sequence
  Synthetic oligonucleotide
gtaatcgcaactagatgtag

SEQ ID NO: 1986 - DNA, 20 bp, Artificial sequence
  Synthetic oligonucleotide
agtaatcgcaactagatgta

SEQ ID NO: 1987 - DNA, 20 bp, Artificial sequence
  Synthetic oligonucleotide
cagtaatcgcaactagatgt

SEQ ID NO: 1988 - DNA, 20 bp, Artificial sequence
  Synthetic oligonucleotide
ccagtaatcgcaactagatg

SEQ ID NO: 1989 - DNA, 20 bp, Artificial sequence
  Synthetic oligonucleotide
gccagtaatcgcaactagat

SEQ ID NO: 1990 - DNA, 20 bp, Artificial sequence
  Synthetic oligonucleotide
tgccagtaatcgcaactaga

SEQ ID NO: 1991 - DNA, 20 bp, Artificial sequence
  Synthetic oligonucleotide
ttgccagtaatcgcaactag

SEQ ID NO: 1992 - DNA, 20 bp, Artificial sequence
  Synthetic oligonucleotide
attgccagtaatcgcaacta

SEQ ID NO: 1993 - DNA, 20 bp, Artificial sequence
  Synthetic oligonucleotide
cattgccagtaatcgcaact

SEQ ID NO: 1994 - DNA, 20 bp, Artificial sequence
  Synthetic oligonucleotide
acattgccagtaatcgcaac

SEQ ID NO: 1995 - DNA, 20 bp, Artificial sequence
  Synthetic oligonucleotide
gacattgccagtaatcgcaa

SEQ ID NO: 1996 - DNA, 20 bp, Artificial sequence
  Synthetic oligonucleotide
gggacattgccagtaatcgc

SEQ ID NO: 1997 - DNA, 20 bp, Artificial sequence
  Synthetic oligonucleotide
ttgttttccgggattgcatt

SEQ ID NO: 1998 - DNA, 20 bp, Artificial sequence
  Synthetic oligonucleotide
tttgttttccgggattgcat

SEQ ID NO: 1999 - DNA, 20 bp, Artificial sequence
  Synthetic oligonucleotide
aatctttgttttccgggatt

SEQ ID NO: 2000 - DNA, 20 bp, Artificial sequence
  Synthetic oligonucleotide
aaatctttgttttccgggat

SEQ ID NO: 2001 - DNA, 20 bp, Artificial sequence
  Synthetic oligonucleotide
aaacaccaaatctttgtttt

SEQ ID NO: 2002 - DNA, 20 bp, Artificial sequence
  Synthetic oligonucleotide
aaaacaccaaatctttgttt

SEQ ID NO: 2003 - DNA, 20 bp, Artificial sequence
  Synthetic oligonucleotide
gtagaaaacaccaaatcttt

SEQ ID NO: 2004 - DNA, 20 bp, Artificial sequence
  Synthetic oligonucleotide
agtagaaaacaccaaatctt

SEQ ID NO: 2005 - DNA, 20 bp, Artificial sequence
  Synthetic oligonucleotide
cccaagtagaaaacaccaaa

SEQ ID NO: 2006 - DNA, 20 bp, Artificial sequence
  Synthetic oligonucleotide
tcccaagtagaaaacaccaa

SEQ ID NO: 2007 - DNA, 20 bp, Artificial sequence
  Synthetic oligonucleotide
gtgatcccaagtagaaaaca

SEQ ID NO: 2008 - DNA, 20 bp, Artificial sequence
  Synthetic oligonucleotide
tgtgatcccaagtagaaaac

SEQ ID NO: 2009 - DNA, 20 bp, Artificial sequence
  Synthetic oligonucleotide
ttgtgatcccaagtagaaaa

SEQ ID NO: 2010 - DNA, 20 bp, Artificial sequence
  Synthetic oligonucleotide
tttgtgatcccaagtagaaa

SEQ ID NO: 2011 - DNA, 20 bp, Artificial sequence
  Synthetic oligonucleotide
cttttgctttgtgatcccaa

SEQ ID NO: 2012 - DNA, 20 bp, Artificial sequence
  Synthetic oligonucleotide
tgtccttttgctttgtgatc

SEQ ID NO: 2013 - DNA, 20 bp, Artificial sequence
  Synthetic oligonucleotide
gtgtccttttgctttgtgat

SEQ ID NO: 2014 - DNA, 20 bp, Artificial sequence
  Synthetic oligonucleotide
agtgtccttttgctttgtga

SEQ ID NO: 2015 - DNA, 20 bp, Artificial sequence
  Synthetic oligonucleotide
ttgaagtgtccttttgcttt

SEQ ID NO: 2016 - DNA, 20 bp, Artificial sequence
  Synthetic oligonucleotide
gttgaagtgtccttttgctt

SEQ ID NO: 2017 - DNA, 20 bp, Artificial sequence
  Synthetic oligonucleotide
agttgaagtgtccttttgct

SEQ ID NO: 2018 - DNA, 20 bp, Artificial sequence
  Synthetic oligonucleotide
cagttgaagtgtccttttgc

SEQ ID NO: 2019 - DNA, 20 bp, Artificial sequence
  Synthetic oligonucleotide
acagttgaagtgtccttttg

SEQ ID NO: 2020 - DNA, 20 bp, Artificial sequence
  Synthetic oligonucleotide
gacagttgaagtgtcctttt

SEQ ID NO: 2021 - DNA, 20 bp, Artificial sequence
  Synthetic oligonucleotide
ggacagttgaagtgtccttt

SEQ ID NO: 2022 - DNA, 20 bp, Artificial sequence
  Synthetic oligonucleotide
tggacagttgaagtgtcctt

SEQ ID NO: 2023 - DNA, 20 bp, Artificial sequence
  Synthetic oligonucleotide
ctggacagttgaagtgtcct

SEQ ID NO: 2024 - DNA, 20 bp, Artificial sequence
  Synthetic oligonucleotide
tctggacagttgaagtgtcc

SEQ ID NO: 2025 - DNA, 20 bp, Artificial sequence
  Synthetic oligonucleotide
ctctggacagttgaagtgtc

SEQ ID NO: 2026 - DNA, 20 bp, Artificial sequence
  Synthetic oligonucleotide
cctctggacagttgaagtgt

SEQ ID NO: 2027 - DNA, 20 bp, Artificial sequence
  Synthetic oligonucleotide
ccctctggacagttgaagtg

SEQ ID NO: 2028 - DNA, 20 bp, Artificial sequence
  Synthetic oligonucleotide
accctctggacagttgaagt

SEQ ID NO: 2029 - DNA, 20 bp, Artificial sequence
  Synthetic oligonucleotide
aaccctctggacagttgaag

SEQ ID NO: 2030 - DNA, 20 bp, Artificial sequence
  Synthetic oligonucleotide
taaccctctggacagttgaa

SEQ ID NO: 2031 - DNA, 20 bp, Artificial sequence
  Synthetic oligonucleotide
ataaccctctggacagttga

SEQ ID NO: 2032 - DNA, 20 bp, Artificial sequence
  Synthetic oligonucleotide
aataaccctctggacagttg

SEQ ID NO: 2033 - DNA, 20 bp, Artificial sequence
  Synthetic oligonucleotide
gaataaccctctggacagtt

SEQ ID NO: 2034 - DNA, 20 bp, Artificial sequence
  Synthetic oligonucleotide
tgaataaccctctggacagt

SEQ ID NO: 2035 - DNA, 20 bp, Artificial sequence
  Synthetic oligonucleotide
ctgaataaccctctggacag

SEQ ID NO: 2036 - DNA, 20 bp, Artificial sequence
  Synthetic oligonucleotide
cctgaataaccctctggaca

SEQ ID NO: 2037 - DNA, 20 bp, Artificial sequence
  Synthetic oligonucleotide
tcctgaataaccctctggac

SEQ ID NO: 2038 - DNA, 20 bp, Artificial sequence
  Synthetic oligonucleotide
ctcctgaataaccctctgga

SEQ ID NO: 2039 - DNA, 20 bp, Artificial sequence
  Synthetic oligonucleotide
cctcctgaataaccctctgg

SEQ ID NO: 2040 - DNA, 20 bp, Artificial sequence
  Synthetic oligonucleotide
gcctcctgaataaccctctg

SEQ ID NO: 2041 - DNA, 20 bp, Artificial sequence
  Synthetic oligonucleotide
agcctcctgaataaccctct

SEQ ID NO: 2042 - DNA, 20 bp, Artificial sequence
  Synthetic oligonucleotide
cagcctcctgaataaccctc

SEQ ID NO: 2043 - DNA, 20 bp, Artificial sequence
  Synthetic oligonucleotide
ccagcctcctgaataaccct

SEQ ID NO: 2044 - DNA, 20 bp, Artificial sequence
  Synthetic oligonucleotide
accagcctcctgaataaccc

SEQ ID NO: 2045 - DNA, 20 bp, Artificial sequence
  Synthetic oligonucleotide
caccagcctcctgaataacc

SEQ ID NO: 2046 - DNA, 20 bp, Artificial sequence
  Synthetic oligonucleotide
ccaccagcctcctgaataac

SEQ ID NO: 2047 - DNA, 20 bp, Artificial sequence
  Synthetic oligonucleotide
accaccagcctcctgaataa

SEQ ID NO: 2048 - DNA, 20 bp, Artificial sequence
  Synthetic oligonucleotide
caccaccagcctcctgaata

SEQ ID NO: 2049 - DNA, 20 bp, Artificial sequence
  Synthetic oligonucleotide
ccaccaccagcctcctgaat

SEQ ID NO: 2050 - DNA, 20 bp, Artificial sequence
  Synthetic oligonucleotide
catgccaccaccagcctcct

SEQ ID NO: 2051 - DNA, 20 bp, Artificial sequence
  Synthetic oligonucleotide
atcatgccaccaccagcctc

SEQ ID NO: 2052 - DNA, 20 bp, Artificial sequence
  Synthetic oligonucleotide
catcatgccaccaccagcct

SEQ ID NO: 2053 - DNA, 20 bp, Artificial sequence
  Synthetic oligonucleotide
acactcatcatgccaccacc

SEQ ID NO: 2054 - DNA, 20 bp, Artificial sequence
  Synthetic oligonucleotide
ttctccacactcatcatgcc

SEQ ID NO: 2055 - DNA, 20 bp, Artificial sequence
  Synthetic oligonucleotide
ttttctccacactcatcatg

SEQ ID NO: 2056 - DNA, 20 bp, Artificial sequence
  Synthetic oligonucleotide
gttttctccacactcatcat

SEQ ID NO: 2057 - DNA, 20 bp, Artificial sequence
  Synthetic oligonucleotide
atttaagaactgtacaatta

SEQ ID NO: 2058 - DNA, 20 bp, Artificial sequence
  Synthetic oligonucleotide
catttaagaactgtacaatt

SEQ ID NO: 2059 - DNA, 20 bp, Artificial sequence
  Synthetic oligonucleotide
acatttaagaactgtacaat

SEQ ID NO: 2060 - DNA, 20 bp, Artificial sequence
  Synthetic oligonucleotide
aacatttaagaactgtacaa

SEQ ID NO: 2061 - DNA, 20 bp, Artificial sequence
  Synthetic oligonucleotide
caacatttaagaactgtaca

SEQ ID NO: 2062 - DNA, 20 bp, Artificial sequence
  Synthetic oligonucleotide
acaacatttaagaactgtac

SEQ ID NO: 2063 - DNA, 20 bp, Artificial sequence
  Synthetic oligonucleotide
tacaacatttaagaactgta

SEQ ID NO: 2064 - DNA, 20 bp, Artificial sequence
  Synthetic oligonucleotide
ctacaacatttaagaactgt

SEQ ID NO: 2065 - DNA, 20 bp, Artificial sequence
  Synthetic oligonucleotide
actacaacatttaagaactg

SEQ ID NO: 2066 - DNA, 20 bp, Artificial sequence
  Synthetic oligonucleotide
tactacaacatttaagaact

SEQ ID NO: 2067 - DNA, 20 bp, Artificial sequence
  Synthetic oligonucleotide
atactacaacatttaagaac

SEQ ID NO: 2068 - DNA, 20 bp, Artificial sequence
  Synthetic oligonucleotide
aatactacaacatttaagaa

SEQ ID NO: 2069 - DNA, 20 bp, Artificial sequence
  Synthetic oligonucleotide
taatactacaacatttaaga

SEQ ID NO: 2070 - DNA, 20 bp, Artificial sequence
  Synthetic oligonucleotide
ttaatactacaacatttaag

SEQ ID NO: 2071 - DNA, 20 bp, Artificial sequence
  Synthetic oligonucleotide
gaaattaatactacaacatt

SEQ ID NO: 2072 - DNA, 20 bp, Artificial sequence
  Synthetic oligonucleotide
ttttgaaattaatactacaa

SEQ ID NO: 2073 - DNA, 20 bp, Artificial sequence
  Synthetic oligonucleotide
gttttgaaattaatactaca

SEQ ID NO: 2074 - DNA, 20 bp, Artificial sequence
  Synthetic oligonucleotide
agttttgaaattaatactac

SEQ ID NO: 2075 - DNA, 20 bp, Artificial sequence
  Synthetic oligonucleotide
tagttttgaaattaatacta

SEQ ID NO: 2076 - DNA, 20 bp, Artificial sequence
  Synthetic oligonucleotide
ttagttttgaaattaatact

SEQ ID NO: 2077 - DNA, 20 bp, Artificial sequence
  Synthetic oligonucleotide
cgatttttagttttgaaatt

SEQ ID NO: 2078 - DNA, 20 bp, Artificial sequence
  Synthetic oligonucleotide
acgatttttagttttgaaat

SEQ ID NO: 2079 - DNA, 20 bp, Artificial sequence
  Synthetic oligonucleotide
gacgatttttagttttgaaa

SEQ ID NO: 2080 - DNA, 20 bp, Artificial sequence
  Synthetic oligonucleotide
tgacgatttttagttttgaa

SEQ ID NO: 2081 - DNA, 20 bp, Artificial sequence
  Synthetic oligonucleotide
ctgacgatttttagttttga

SEQ ID NO: 2082 - DNA, 20 bp, Artificial sequence
  Synthetic oligonucleotide
tgctgacgatttttagtttt

SEQ ID NO: 2083 - DNA, 20 bp, Artificial sequence
  Synthetic oligonucleotide
gtgctgacgatttttagttt

SEQ ID NO: 2084 - DNA, 20 bp, Artificial sequence
  Synthetic oligonucleotide
tgtgctgacgatttttagtt

SEQ ID NO: 2085 - DNA, 20 bp, Artificial sequence
  Synthetic oligonucleotide
ctgtgctgacgatttttagt

SEQ ID NO: 2086 - DNA, 20 bp, Artificial sequence
  Synthetic oligonucleotide
tctgtgctgacgatttttag

SEQ ID NO: 2087 - DNA, 20 bp, Artificial sequence
  Synthetic oligonucleotide
ctctgtgctgacgattttta

SEQ ID NO: 2088 - DNA, 20 bp, Artificial sequence
  Synthetic oligonucleotide
actctgtgctgacgattttt

SEQ ID NO: 2089 - DNA, 20 bp, Artificial sequence
  Synthetic oligonucleotide
tactctgtgctgacgatttt

SEQ ID NO: 2090 - DNA, 20 bp, Artificial sequence
  Synthetic oligonucleotide
atactctgtgctgacgattt

SEQ ID NO: 2091 - DNA, 20 bp, Artificial sequence
  Synthetic oligonucleotide
catactctgtgctgacgatt

SEQ ID NO: 2092 - DNA, 20 bp, Artificial sequence
  Synthetic oligonucleotide
acatactctgtgctgacgat

SEQ ID NO: 2093 - DNA, 20 bp, Artificial sequence
  Synthetic oligonucleotide
tttttacacatactctgtgc

SEQ ID NO: 2094 - DNA, 20 bp, Artificial sequence
  Synthetic oligonucleotide
cagatttttacacatactct

SEQ ID NO: 2095 - DNA, 20 bp, Artificial sequence
  Synthetic oligonucleotide
acagatttttacacatactc

SEQ ID NO: 2096 - DNA, 20 bp, Artificial sequence
  Synthetic oligonucleotide
tacagatttttacacatact

SEQ ID NO: 2097 - DNA, 20 bp, Artificial sequence
  Synthetic oligonucleotide
ttacagatttttacacatac

SEQ ID NO: 2098 - DNA, 20 bp, Artificial sequence
  Synthetic oligonucleotide
tattacagatttttacacat

SEQ ID NO: 2099 - DNA, 20 bp, Artificial sequence
  Synthetic oligonucleotide
tgtattacagatttttacac

SEQ ID NO: 2100 - DNA, 20 bp, Artificial sequence
  Synthetic oligonucleotide
cagtttaaaaatttgtatta

SEQ ID NO: 2101 - DNA, 20 bp, Artificial sequence
  Synthetic oligonucleotide
catcagtttaaaaatttgta

SEQ ID NO: 2102 - DNA, 20 bp, Artificial sequence
  Synthetic oligonucleotide
aagcatcagtttaaaaattt

SEQ ID NO: 2103 - DNA, 20 bp, Artificial sequence
  Synthetic oligonucleotide
gaagcatcagtttaaaaatt

SEQ ID NO: 2104 - DNA, 20 bp, Artificial sequence
  Synthetic oligonucleotide
tagcaaaatgaagcatcagt

SEQ ID NO: 2105 - DNA, 20 bp, Artificial sequence
  Synthetic oligonucleotide
gtagcaaaatgaagcatcag

SEQ ID NO: 2106 - DNA, 20 bp, Artificial sequence
  Synthetic oligonucleotide
tgtagcaaaatgaagcatca

SEQ ID NO: 2107 - DNA, 20 bp, Artificial sequence
  Synthetic oligonucleotide
ttgtagcaaaatgaagcatc

SEQ ID NO: 2108 - DNA, 20 bp, Artificial sequence
  Synthetic oligonucleotide
tttgtagcaaaatgaagcat

SEQ ID NO: 2109 - DNA, 20 bp, Artificial sequence
  Synthetic oligonucleotide
aacatttactccaaattatt

SEQ ID NO: 2110 - DNA, 20 bp, Artificial sequence
  Synthetic oligonucleotide
caaacatttactccaaatta

SEQ ID NO: 2111 - DNA, 20 bp, Artificial sequence
  Synthetic oligonucleotide
atcaaacatttactccaaat

SEQ ID NO: 2112 - DNA, 20 bp, Artificial sequence
  Synthetic oligonucleotide
catatcaaacatttactcca

SEQ ID NO: 2113 - DNA, 20 bp, Artificial sequence
  Synthetic oligonucleotide
tcatatcaaacatttactcc

SEQ ID NO: 2114 - DNA, 20 bp, Artificial sequence
  Synthetic oligonucleotide
atcatatcaaacatttactc

SEQ ID NO: 2115 - DNA, 20 bp, Artificial sequence
  Synthetic oligonucleotide
taaataaatcatatcaaaca

SEQ ID NO: 2116 - DNA, 20 bp, Artificial sequence
  Synthetic oligonucleotide
tcataaataaatcatatcaa

SEQ ID NO: 2117 - DNA, 20 bp, Artificial sequence
  Synthetic oligonucleotide
ttcataaataaatcatatca

SEQ ID NO: 2118 - DNA, 20 bp, Artificial sequence
  Synthetic oligonucleotide
tttcataaataaatcatatc

SEQ ID NO: 2119 - DNA, 20 bp, Artificial sequence
  Synthetic oligonucleotide
gtttcataaataaatcatat

SEQ ID NO: 2120 - DNA, 20 bp, Artificial sequence
  Synthetic oligonucleotide
ggtttcataaataaatcata

SEQ ID NO: 2121 - DNA, 20 bp, Artificial sequence
  Synthetic oligonucleotide
aggtttcataaataaatcat

SEQ ID NO: 2122 - DNA, 20 bp, Artificial sequence
  Synthetic oligonucleotide
taggtttcataaataaatca

SEQ ID NO: 2123 - DNA, 20 bp, Artificial sequence
  Synthetic oligonucleotide
attaggtttcataaataaat

SEQ ID NO: 2124 - DNA, 20 bp, Artificial sequence
  Synthetic oligonucleotide
cattaggtttcataaataaa

SEQ ID NO: 2125 - DNA, 20 bp, Artificial sequence
  Synthetic oligonucleotide
tcattaggtttcataaataa

SEQ ID NO: 2126 - DNA, 20 bp, Artificial sequence
  Synthetic oligonucleotide
ttcattaggtttcataaata

SEQ ID NO: 2127 - DNA, 20 bp, Artificial sequence
  Synthetic oligonucleotide
cttcattaggtttcataaat

SEQ ID NO: 2128 - DNA, 20 bp, Artificial sequence
  Synthetic oligonucleotide
gcttcattaggtttcataaa

SEQ ID NO: 2129 - DNA, 20 bp, Artificial sequence
  Synthetic oligonucleotide
ttctgcttcattaggtttca

SEQ ID NO: 2130 - DNA, 20 bp, Artificial sequence
  Synthetic oligonucleotide
taattctgcttcattaggtt

SEQ ID NO: 2131 - DNA, 20 bp, Artificial sequence
  Synthetic oligonucleotide
tatgtagttcttctcagttc

SEQ ID NO: 2132 - DNA, 20 bp, Artificial sequence
  Synthetic oligonucleotide
tagtttatatgtagttcttc

SEQ ID NO: 2133 - DNA, 20 bp, Artificial sequence
  Synthetic oligonucleotide
cttgtagtttatatgtagtt

SEQ ID NO: 2134 - DNA, 20 bp, Artificial sequence
  Synthetic oligonucleotide
ttgacttgtagtttatatgt

SEQ ID NO: 2135 - DNA, 20 bp, Artificial sequence
  Synthetic oligonucleotide
ttttgacttgtagtttatat

SEQ ID NO: 2136 - DNA, 20 bp, Artificial sequence
  Synthetic oligonucleotide
atttttgacttgtagtttat

SEQ ID NO: 2137 - DNA, 20 bp, Artificial sequence
  Synthetic oligonucleotide
tcttcatttttgacttgtag

SEQ ID NO: 2138 - DNA, 20 bp, Artificial sequence
  Synthetic oligonucleotide
tacctcttcatttttgactt

SEQ ID NO: 2139 - DNA, 20 bp, Artificial sequence
  Synthetic oligonucleotide
attctttacctcttcatttt

SEQ ID NO: 2140 - DNA, 20 bp, Artificial sequence
  Synthetic oligonucleotide
caagtgacatattctttacc

SEQ ID NO: 2141 - DNA, 20 bp, Artificial sequence
  Synthetic oligonucleotide
ttcaagtgacatattcttta

SEQ ID NO: 2142 - DNA, 20 bp, Artificial sequence
  Synthetic oligonucleotide
ttgagttcaagtgacatatt

SEQ ID NO: 2143 - DNA, 20 bp, Artificial sequence
  Synthetic oligonucleotide
agttgagttcaagtgacata

SEQ ID NO: 2144 - DNA, 20 bp, Artificial sequence
  Synthetic oligonucleotide
tttgagttgagttcaagtga

SEQ ID NO: 2145 - DNA, 20 bp, Artificial sequence
  Synthetic oligonucleotide
tttcaagttttgagttgagt

SEQ ID NO: 2146 - DNA, 20 bp, Artificial sequence
  Synthetic oligonucleotide
gctttcaagttttgagttga

SEQ ID NO: 2147 - DNA, 20 bp, Artificial sequence
  Synthetic oligonucleotide
aggctttcaagttttgagtt

SEQ ID NO: 2148 - DNA, 20 bp, Artificial sequence
  Synthetic oligonucleotide
taggaggctttcaagttttg

SEQ ID NO: 2149 - DNA, 20 bp, Artificial sequence
  Synthetic oligonucleotide
ttctaggaggctttcaagtt

SEQ ID NO: 2150 - DNA, 20 bp, Artificial sequence
  Synthetic oligonucleotide
tcttctaggaggctttcaag

SEQ ID NO: 2151 - DNA, 20 bp, Artificial sequence
  Synthetic oligonucleotide
gaattttttcttctaggagg

SEQ ID NO: 2152 - DNA, 20 bp, Artificial sequence
  Synthetic oligonucleotide
aagtagaattttttcttcta

SEQ ID NO: 2153 - DNA, 20 bp, Artificial sequence
  Synthetic oligonucleotide
tgaagtagaattttttcttc

SEQ ID NO: 2154 - DNA, 20 bp, Artificial sequence
  Synthetic oligonucleotide
gttgaagtagaattttttct

SEQ ID NO: 2155 - DNA, 20 bp, Artificial sequence
  Synthetic oligonucleotide
tttgttgaagtagaattttt

SEQ ID NO: 2156 - DNA, 20 bp, Artificial sequence
  Synthetic oligonucleotide
tttttgttgaagtagaattt

SEQ ID NO: 2157 - DNA, 20 bp, Artificial sequence
  Synthetic oligonucleotide
ttgctcttctaaatatttca

SEQ ID NO: 2158 - DNA, 20 bp, Artificial sequence
  Synthetic oligonucleotide
agttgctcttctaaatattt

SEQ ID NO: 2159 - DNA, 20 bp, Artificial sequence
  Synthetic oligonucleotide
ttagttgctcttctaaatat

SEQ ID NO: 2160 - DNA, 20 bp, Artificial sequence
  Synthetic oligonucleotide
tagttagttgctcttctaaa

SEQ ID NO: 2161 - DNA, 20 bp, Artificial sequence
  Synthetic oligonucleotide
taagttagttagttgctctt

SEQ ID NO: 2162 - DNA, 20 bp, Artificial sequence
  Synthetic oligonucleotide
attaagttagttagttgctc

SEQ ID NO: 2163 - DNA, 20 bp, Artificial sequence
  Synthetic oligonucleotide
gaattaagttagttagttgc

SEQ ID NO: 2164 - DNA, 20 bp, Artificial sequence
  Synthetic oligonucleotide
ttgaattaagttagttagtt

SEQ ID NO: 2165 - DNA, 20 bp, Artificial sequence
  Synthetic oligonucleotide
ttttgaattaagttagttag

SEQ ID NO: 2166 - DNA, 20 bp, Artificial sequence
  Synthetic oligonucleotide
tgattttgaattaagttagt

SEQ ID NO: 2167 - DNA, 20 bp, Artificial sequence
  Synthetic oligonucleotide
ggttgattttgaattaagtt

SEQ ID NO: 2168 - DNA, 20 bp, Artificial sequence
  Synthetic oligonucleotide
agtttcaggttgattttgaa

SEQ ID NO: 2169 - DNA, 20 bp, Artificial sequence
  Synthetic oligonucleotide
ctggagtttcaggttgattt

SEQ ID NO: 2170 - DNA, 20 bp, Artificial sequence
  Synthetic oligonucleotide
ggtgttctggagtttcaggt

SEQ ID NO: 2171 - DNA, 20 bp, Artificial sequence
  Synthetic oligonucleotide
tgggtgttctggagtttcag

SEQ ID NO: 2172 - DNA, 20 bp, Artificial sequence
  Synthetic oligonucleotide
tctgggtgttctggagtttc

SEQ ID NO: 2173 - DNA, 20 bp, Artificial sequence
  Synthetic oligonucleotide
cttctgggtgttctggagtt

SEQ ID NO: 2174 - DNA, 20 bp, Artificial sequence
  Synthetic oligonucleotide
tacttctgggtgttctggag

SEQ ID NO: 2175 - DNA, 20 bp, Artificial sequence
  Synthetic oligonucleotide
gttacttctgggtgttctgg

SEQ ID NO: 2176 - DNA, 20 bp, Artificial sequence
  Synthetic oligonucleotide
aagttacttctgggtgttct

SEQ ID NO: 2177 - DNA, 20 bp, Artificial sequence
  Synthetic oligonucleotide
gtgaagttacttctgggtgt

SEQ ID NO: 2178 - DNA, 20 bp, Artificial sequence
  Synthetic oligonucleotide
ttttaagtgaagttacttct

SEQ ID NO: 2179 - DNA, 20 bp, Artificial sequence
  Synthetic oligonucleotide
agttttaagtgaagttactt

SEQ ID NO: 2180 - DNA, 20 bp, Artificial sequence
  Synthetic oligonucleotide
aaagttttaagtgaagttac

SEQ ID NO: 2181 - DNA, 20 bp, Artificial sequence
  Synthetic oligonucleotide
acaaaagttttaagtgaagt

SEQ ID NO: 2182 - DNA, 20 bp, Artificial sequence
  Synthetic oligonucleotide
ctacaaaagttttaagtgaa

SEQ ID NO: 2183 - DNA, 20 bp, Artificial sequence
  Synthetic oligonucleotide
ttctacaaaagttttaagtg

SEQ ID NO: 2184 - DNA, 20 bp, Artificial sequence
  Synthetic oligonucleotide
tgtttttctacaaaagtttt

SEQ ID NO: 2185 - DNA, 20 bp, Artificial sequence
  Synthetic oligonucleotide
cttgtttttctacaaaagtt

SEQ ID NO: 2186 - DNA, 20 bp, Artificial sequence
  Synthetic oligonucleotide
tattatcttgtttttctaca

SEQ ID NO: 2187 - DNA, 20 bp, Artificial sequence
  Synthetic oligonucleotide
gatgctattatcttgttttt

SEQ ID NO: 2188 - DNA, 20 bp, Artificial sequence
  Synthetic oligonucleotide
tttgatgctattatcttgtt

SEQ ID NO: 2189 - DNA, 20 bp, Artificial sequence
  Synthetic oligonucleotide
tctttgatgctattatcttg

SEQ ID NO: 2190 - DNA, 20 bp, Artificial sequence
  Synthetic oligonucleotide
gagaaggtctttgatgctat

SEQ ID NO: 2191 - DNA, 20 bp, Artificial sequence
  Synthetic oligonucleotide
gtctggagaaggtctttgat

SEQ ID NO: 2192 - DNA, 20 bp, Artificial sequence
  Synthetic oligonucleotide
cggtctggagaaggtctttg

SEQ ID NO: 2193 - DNA, 20 bp, Artificial sequence
  Synthetic oligonucleotide
cacggtctggagaaggtctt

SEQ ID NO: 2194 - DNA, 20 bp, Artificial sequence
  Synthetic oligonucleotide
tccacggtctggagaaggtc

SEQ ID NO: 2195 - DNA, 20 bp, Artificial sequence
  Synthetic oligonucleotide
cttccacggtctggagaagg

SEQ ID NO: 2196 - DNA, 20 bp, Artificial sequence
  Synthetic oligonucleotide
gtcttccacggtctggagaa

SEQ ID NO: 2197 - DNA, 20 bp, Artificial sequence
  Synthetic oligonucleotide
tggtcttccacggtctggag

SEQ ID NO: 2198 - DNA, 20 bp, Artificial sequence
  Synthetic oligonucleotide
attggtcttccacggtctgg

SEQ ID NO: 2199 - DNA, 20 bp, Artificial sequence
  Synthetic oligonucleotide
atattggtcttccacggtct

SEQ ID NO: 2200 - DNA, 20 bp, Artificial sequence
  Synthetic oligonucleotide
ttatattggtcttccacggt

SEQ ID NO: 2201 - DNA, 20 bp, Artificial sequence
  Synthetic oligonucleotide
gtttatattggtcttccacg

SEQ ID NO: 2202 - DNA, 20 bp, Artificial sequence
  Synthetic oligonucleotide
ttgtttatattggtcttcca

SEQ ID NO: 2203 - DNA, 20 bp, Artificial sequence
  Synthetic oligonucleotide
aattgtttatattggtcttc

SEQ ID NO: 2204 - DNA, 20 bp, Artificial sequence
  Synthetic oligonucleotide
ttaattgtttatattggtct

SEQ ID NO: 2205 - DNA, 20 bp, Artificial sequence
  Synthetic oligonucleotide
gtttaattgtttatattggt

SEQ ID NO: 2206 - DNA, 20 bp, Artificial sequence
  Synthetic oligonucleotide
tggtttaattgtttatattg

SEQ ID NO: 2207 - DNA, 20 bp, Artificial sequence
  Synthetic oligonucleotide
gttggtttaattgtttatat

SEQ ID NO: 2208 - DNA, 20 bp, Artificial sequence
  Synthetic oligonucleotide
tttgtgatccatctattcga

SEQ ID NO: 2209 - DNA, 20 bp, Artificial sequence
  Synthetic oligonucleotide
ttttgtgatccatctattcg

SEQ ID NO: 2210 - DNA, 20 bp, Artificial sequence
  Synthetic oligonucleotide
attgaagttttgtgatccat

SEQ ID NO: 2211 - DNA, 20 bp, Artificial sequence
  Synthetic oligonucleotide
cattgaagttttgtgatcca

SEQ ID NO: 2212 - DNA, 20 bp, Artificial sequence
  Synthetic oligonucleotide
tcattgaagttttgtgatcc

SEQ ID NO: 2213 - DNA, 20 bp, Artificial sequence
  Synthetic oligonucleotide
ttcattgaagttttgtgatc

SEQ ID NO: 2214 - DNA, 20 bp, Artificial sequence
  Synthetic oligonucleotide
tttcattgaagttttgtgat

SEQ ID NO: 2215 - DNA, 20 bp, Artificial sequence
  Synthetic oligonucleotide
atatttgtagttctcccacg

SEQ ID NO: 2216 - DNA, 20 bp, Artificial sequence
  Synthetic oligonucleotide
ccaaaaccatatttgtagtt

SEQ ID NO: 2217 - DNA, 20 bp, Artificial sequence
  Synthetic oligonucleotide
cccaaaaccatatttgtagt

SEQ ID NO: 2218 - DNA, 20 bp, Artificial sequence
  Synthetic oligonucleotide
tcccaaaaccatatttgtag

SEQ ID NO: 2219 - DNA, 20 bp, Artificial sequence
  Synthetic oligonucleotide
ctcccaaaaccatatttgta

SEQ ID NO: 2220 - DNA, 20 bp, Artificial sequence
  Synthetic oligonucleotide
agcctcccaaaaccatattt

SEQ ID NO: 2221 - DNA, 20 bp, Artificial sequence
  Synthetic oligonucleotide
caagcctcccaaaaccatat

SEQ ID NO: 2222 - DNA, 20 bp, Artificial sequence
  Synthetic oligonucleotide
tcaagcctcccaaaaccata

SEQ ID NO: 2223 - DNA, 20 bp, Artificial sequence
  Synthetic oligonucleotide
atcaagcctcccaaaaccat

SEQ ID NO: 2224 - DNA, 20 bp, Artificial sequence
  Synthetic oligonucleotide
catcaagcctcccaaaacca

SEQ ID NO: 2225 - DNA, 20 bp, Artificial sequence
  Synthetic oligonucleotide
ccatcaagcctcccaaaacc

SEQ ID NO: 2226 - DNA, 20 bp, Artificial sequence
  Synthetic oligonucleotide
tccatcaagcctcccaaaac

SEQ ID NO: 2227 - DNA, 20 bp, Artificial sequence
  Synthetic oligonucleotide
ctccatcaagcctcccaaaa

SEQ ID NO: 2228 - DNA, 20 bp, Artificial sequence
  Synthetic oligonucleotide
aaaattctccatcaagcctc

SEQ ID NO: 2229 - DNA, 20 bp, Artificial sequence
  Synthetic oligonucleotide
ccaaaattctccatcaagcc

SEQ ID NO: 2230 - DNA, 20 bp, Artificial sequence
  Synthetic oligonucleotide
accaaaattctccatcaagc

SEQ ID NO: 2231 - DNA, 20 bp, Artificial sequence
  Synthetic oligonucleotide
ccaaccaaaattctccatca

SEQ ID NO: 2232 - DNA, 20 bp, Artificial sequence
  Synthetic oligonucleotide
cccaaccaaaattctccatc

SEQ ID NO: 2233 - DNA, 20 bp, Artificial sequence
  Synthetic oligonucleotide
gcccaaccaaaattctccat

SEQ ID NO: 2234 - DNA, 20 bp, Artificial sequence
  Synthetic oligonucleotide
ggcccaaccaaaattctcca

SEQ ID NO: 2235 - DNA, 20 bp, Artificial sequence
  Synthetic oligonucleotide
aggcccaaccaaaattctcc

SEQ ID NO: 2236 - DNA, 20 bp, Artificial sequence
  Synthetic oligonucleotide
taggcccaaccaaaattctc

SEQ ID NO: 2237 - DNA, 20 bp, Artificial sequence
  Synthetic oligonucleotide
ctaggcccaaccaaaattct

SEQ ID NO: 2238 - DNA, 20 bp, Artificial sequence
  Synthetic oligonucleotide
tctaggcccaaccaaaattc

SEQ ID NO: 2239 - DNA, 20 bp, Artificial sequence
  Synthetic oligonucleotide
ctctaggcccaaccaaaatt

SEQ ID NO: 2240 - DNA, 20 bp, Artificial sequence
  Synthetic oligonucleotide
tctctaggcccaaccaaaat

SEQ ID NO: 2241 - DNA, 20 bp, Artificial sequence
  Synthetic oligonucleotide
ttctctaggcccaaccaaaa

SEQ ID NO: 2242 - DNA, 20 bp, Artificial sequence
  Synthetic oligonucleotide
cttctctaggcccaaccaaa

SEQ ID NO: 2243 - DNA, 20 bp, Artificial sequence
  Synthetic oligonucleotide
atatcttctctaggcccaac

SEQ ID NO: 2244 - DNA, 20 bp, Artificial sequence
  Synthetic oligonucleotide
tatatcttctctaggcccaa

SEQ ID NO: 2245 - DNA, 20 bp, Artificial sequence
  Synthetic oligonucleotide
gtatatcttctctaggccca

SEQ ID NO: 2246 - DNA, 20 bp, Artificial sequence
  Synthetic oligonucleotide
atggagtatatcttctctag

SEQ ID NO: 2247 - DNA, 20 bp, Artificial sequence
  Synthetic oligonucleotide
cactatggagtatatcttct

SEQ ID NO: 2248 - DNA, 20 bp, Artificial sequence
  Synthetic oligonucleotide
tcactatggagtatatcttc

SEQ ID NO: 2249 - DNA, 20 bp, Artificial sequence
  Synthetic oligonucleotide
ttcactatggagtatatctt

SEQ ID NO: 2250 - DNA, 20 bp, Artificial sequence
  Synthetic oligonucleotide
ttgcttcactatggagtata

SEQ ID NO: 2251 - DNA, 20 bp, Artificial sequence
  Synthetic oligonucleotide
attgcttcactatggagtat

SEQ ID NO: 2252 - DNA, 20 bp, Artificial sequence
  Synthetic oligonucleotide
ttagattgcttcactatgga

SEQ ID NO: 2253 - DNA, 20 bp, Artificial sequence
  Synthetic oligonucleotide
attagattgcttcactatgg

SEQ ID NO: 2254 - DNA, 20 bp, Artificial sequence
  Synthetic oligonucleotide
aattagattgcttcactatg

SEQ ID NO: 2255 - DNA, 20 bp, Artificial sequence
  Synthetic oligonucleotide
taattagattgcttcactat

SEQ ID NO: 2256 - DNA, 20 bp, Artificial sequence
  Synthetic oligonucleotide
ataattagattgcttcacta

SEQ ID NO: 2257 - DNA, 20 bp, Artificial sequence
  Synthetic oligonucleotide
cataattagattgcttcact

SEQ ID NO: 2258 - DNA, 20 bp, Artificial sequence
  Synthetic oligonucleotide
acataattagattgcttcac

SEQ ID NO: 2259 - DNA, 20 bp, Artificial sequence
  Synthetic oligonucleotide
aacataattagattgcttca

SEQ ID NO: 2260 - DNA, 20 bp, Artificial sequence
  Synthetic oligonucleotide
aaacataattagattgcttc

SEQ ID NO: 2261 - DNA, 20 bp, Artificial sequence
  Synthetic oligonucleotide
aaaacataattagattgctt

SEQ ID NO: 2262 - DNA, 20 bp, Artificial sequence
  Synthetic oligonucleotide
taaaacataattagattgct

SEQ ID NO: 2263 - DNA, 20 bp, Artificial sequence
  Synthetic oligonucleotide
gtaaaacataattagattgc

SEQ ID NO: 2264 - DNA, 20 bp, Artificial sequence
  Synthetic oligonucleotide
cgtaaaacataattagattg

SEQ ID NO: 2265 - DNA, 20 bp, Artificial sequence
  Synthetic oligonucleotide
ttccagtcttccaactcaat

SEQ ID NO: 2266 - DNA, 20 bp, Artificial sequence
  Synthetic oligonucleotide
ctttccagtcttccaactca

SEQ ID NO: 2267 - DNA, 20 bp, Artificial sequence
  Synthetic oligonucleotide
ttgttgtctttccagtcttc

SEQ ID NO: 2268 - DNA, 20 bp, Artificial sequence
  Synthetic oligonucleotide
ataatgtttgttgtctttcc

SEQ ID NO: 2269 - DNA, 20 bp, Artificial sequence
  Synthetic oligonucleotide
tataatgtttgttgtctttc

SEQ ID NO: 2270 - DNA, 20 bp, Artificial sequence
  Synthetic oligonucleotide
atataatgtttgttgtcttt

SEQ ID NO: 2271 - DNA, 20 bp, Artificial sequence
  Synthetic oligonucleotide
tcaatataatgtttgttgtc

SEQ ID NO: 2272 - DNA, 20 bp, Artificial sequence
  Synthetic oligonucleotide
atattcaatataatgtttgt

SEQ ID NO: 2273 - DNA, 20 bp, Artificial sequence
  Synthetic oligonucleotide
aatattcaatataatgtttg

SEQ ID NO: 2274 - DNA, 20 bp, Artificial sequence
  Synthetic oligonucleotide
gaatattcaatataatgttt

SEQ ID NO: 2275 - DNA, 20 bp, Artificial sequence
  Synthetic oligonucleotide
agaatattcaatataatgtt

SEQ ID NO: 2276 - DNA, 20 bp, Artificial sequence
  Synthetic oligonucleotide
aagaatattcaatataatgt

SEQ ID NO: 2277 - DNA, 20 bp, Artificial sequence
  Synthetic oligonucleotide
caagtaaaaagaatattcaa

SEQ ID NO: 2278 - DNA, 20 bp, Artificial sequence
  Synthetic oligonucleotide
ccaagtaaaaagaatattca

SEQ ID NO: 2279 - DNA, 20 bp, Artificial sequence
  Synthetic oligonucleotide
cccaagtaaaaagaatattc

SEQ ID NO: 2280 - DNA, 20 bp, Artificial sequence
  Synthetic oligonucleotide
tttcccaagtaaaaagaata

SEQ ID NO: 2281 - DNA, 20 bp, Artificial sequence
  Synthetic oligonucleotide
atttcccaagtaaaaagaat

SEQ ID NO: 2282 - DNA, 20 bp, Artificial sequence
  Synthetic oligonucleotide
gatttcccaagtaaaaagaa

SEQ ID NO: 2283 - DNA, 20 bp, Artificial sequence
  Synthetic oligonucleotide
tgatttcccaagtaaaaaga

SEQ ID NO: 2284 - DNA, 20 bp, Artificial sequence
  Synthetic oligonucleotide
aatcgcaactagatgtagcg

SEQ ID NO: 2285 - DNA, 20 bp, Artificial sequence
  Synthetic oligonucleotide
attctttaaggttatgtgat

SEQ ID NO: 2286 - DNA, 20 bp, Artificial sequence
  Synthetic oligonucleotide
tattctttaaggttatgtga

SEQ ID NO: 2287 - DNA, 20 bp, Artificial sequence
  Synthetic oligonucleotide
acggtattctttaaggttat

SEQ ID NO: 2288 - DNA, 20 bp, Artificial sequence
  Synthetic oligonucleotide
aacggtattctttaaggtta

SEQ ID NO: 2289 - DNA, 20 bp, Artificial sequence
  Synthetic oligonucleotide
aaacggtattctttaaggtt

SEQ ID NO: 2290 - DNA, 20 bp, Artificial sequence
  Synthetic oligonucleotide
taaacggtattctttaaggt

SEQ ID NO: 2291 - DNA, 20 bp, Artificial sequence
  Synthetic oligonucleotide
gtaaacggtattctttaagg

SEQ ID NO: 2292 - DNA, 20 bp, Artificial sequence
  Synthetic oligonucleotide
tgtaaacggtattctttaag

SEQ ID NO: 2293 - DNA, 20 bp, Artificial sequence
  Synthetic oligonucleotide
atgtaaacggtattctttaa

SEQ ID NO: 2294 - DNA, 20 bp, Artificial sequence
  Synthetic oligonucleotide
aatgtaaacggtattcttta

SEQ ID NO: 2295 - DNA, 20 bp, Artificial sequence
  Synthetic oligonucleotide
aaatgtaaacggtattcttt

SEQ ID NO: 2296 - DNA, 20 bp, Artificial sequence
  Synthetic oligonucleotide
gaaatgtaaacggtattctt

SEQ ID NO: 2297 - DNA, 20 bp, Artificial sequence
  Synthetic oligonucleotide
agaaatgtaaacggtattct

SEQ ID NO: 2298 - DNA, 20 bp, Artificial sequence
  Synthetic oligonucleotide
gagaaatgtaaacggtattc

SEQ ID NO: 2299 - DNA, 20 bp, Artificial sequence
  Synthetic oligonucleotide
tgagaaatgtaaacggtatt

SEQ ID NO: 2300 - DNA, 20 bp, Artificial sequence
  Synthetic oligonucleotide
ttgagaaatgtaaacggtat

SEQ ID NO: 2301 - DNA, 20 bp, Artificial sequence
  Synthetic oligonucleotide
attgagaaatgtaaacggta

SEQ ID NO: 2302 - DNA, 20 bp, Artificial sequence
  Synthetic oligonucleotide
gattgagaaatgtaaacggt

SEQ ID NO: 2303 - DNA, 20 bp, Artificial sequence
  Synthetic oligonucleotide
tgattgagaaatgtaaacgg

SEQ ID NO: 2304 - DNA, 20 bp, Artificial sequence
  Synthetic oligonucleotide
ttgattgagaaatgtaaacg

SEQ ID NO: 2305 - DNA, 20 bp, Artificial sequence
  Synthetic oligonucleotide
tttgattgagaaatgtaaac

SEQ ID NO: 2306 - DNA, 20 bp, Artificial sequence
  Synthetic oligonucleotide
ttttgattgagaaatgtaaa

SEQ ID NO: 2307 - DNA, 20 bp, Artificial sequence
  Synthetic oligonucleotide
attttgattgagaaatgtaa

SEQ ID NO: 2308 - DNA, 20 bp, Artificial sequence
  Synthetic oligonucleotide
aattttgattgagaaatgta

SEQ ID NO: 2309 - DNA, 20 bp, Artificial sequence
  Synthetic oligonucleotide
gaattttgattgagaaatgt

SEQ ID NO: 2310 - DNA, 20 bp, Artificial sequence
  Synthetic oligonucleotide
agaattttgattgagaaatg

SEQ ID NO: 2311 - DNA, 20 bp, Artificial sequence
  Synthetic oligonucleotide
aagaattttgattgagaaat

SEQ ID NO: 2312 - DNA, 20 bp, Artificial sequence
  Synthetic oligonucleotide
ataagaattttgattgagaa

SEQ ID NO: 2313 - DNA, 20 bp, Artificial sequence
  Synthetic oligonucleotide
tataagaattttgattgaga

SEQ ID NO: 2314 - DNA, 20 bp, Artificial sequence
  Synthetic oligonucleotide
ttataagaattttgattgag

SEQ ID NO: 2315 - DNA, 20 bp, Artificial sequence
  Synthetic oligonucleotide
attataagaattttgattga

SEQ ID NO: 2316 - DNA, 20 bp, Artificial sequence
  Synthetic oligonucleotide
tattataagaattttgattg

SEQ ID NO: 2317 - DNA, 20 bp, Artificial sequence
  Synthetic oligonucleotide
gtattataagaattttgatt

SEQ ID NO: 2318 - DNA, 20 bp, Artificial sequence
  Synthetic oligonucleotide
agtattataagaattttgat

SEQ ID NO: 2319 - DNA, 20 bp, Artificial sequence
  Synthetic oligonucleotide
tagtattataagaattttga

SEQ ID NO: 2320 - DNA, 20 bp, Artificial sequence
  Synthetic oligonucleotide
aaaacaaatagtattataag

SEQ ID NO: 2321 - DNA, 20 bp, Artificial sequence
  Synthetic oligonucleotide
taaaacaaatagtattataa

SEQ ID NO: 2322 - DNA, 20 bp, Artificial sequence
  Synthetic oligonucleotide
attcccacatcacaaaattt

SEQ ID NO: 2323 - DNA, 20 bp, Artificial sequence
  Synthetic oligonucleotide
gattcccacatcacaaaatt

SEQ ID NO: 2324 - DNA, 20 bp, Artificial sequence
  Synthetic oligonucleotide
tgattcccacatcacaaaat

SEQ ID NO: 2325 - DNA, 20 bp, Artificial sequence
  Synthetic oligonucleotide
aaattgattcccacatcaca

SEQ ID NO: 2326 - DNA, 20 bp, Artificial sequence
  Synthetic oligonucleotide
aaaattgattcccacatcac

SEQ ID NO: 2327 - DNA, 20 bp, Artificial sequence
  Synthetic oligonucleotide
atctaaaattgattcccaca

SEQ ID NO: 2328 - DNA, 20 bp, Artificial sequence
  Synthetic oligonucleotide
gaccatctaaaattgattcc

SEQ ID NO: 2329 - DNA, 20 bp, Artificial sequence
  Synthetic oligonucleotide
tgaccatctaaaattgattc

SEQ ID NO: 2330 - DNA, 20 bp, Artificial sequence
  Synthetic oligonucleotide
gtgaccatctaaaattgatt

SEQ ID NO: 2331 - DNA, 20 bp, Artificial sequence
  Synthetic oligonucleotide
tgtgaccatctaaaattgat

SEQ ID NO: 2332 - DNA, 20 bp, Artificial sequence
  Synthetic oligonucleotide
ttgtgaccatctaaaattga

SEQ ID NO: 2333 - DNA, 20 bp, Artificial sequence
  Synthetic oligonucleotide
attgtgaccatctaaaattg

SEQ ID NO: 2334 - DNA, 20 bp, Artificial sequence
  Synthetic oligonucleotide
gattgtgaccatctaaaatt

SEQ ID NO: 2335 - DNA, 20 bp, Artificial sequence
  Synthetic oligonucleotide
agattgtgaccatctaaaat

SEQ ID NO: 2336 - DNA, 20 bp, Artificial sequence
  Synthetic oligonucleotide
tagattgtgaccatctaaaa

SEQ ID NO: 2337 - DNA, 20 bp, Artificial sequence
  Synthetic oligonucleotide
ctagattgtgaccatctaaa

SEQ ID NO: 2338 - DNA, 20 bp, Artificial sequence
  Synthetic oligonucleotide
tctagattgtgaccatctaa

SEQ ID NO: 2339 - DNA, 20 bp, Artificial sequence
  Synthetic oligonucleotide
atctagattgtgaccatcta

SEQ ID NO: 2340 - DNA, 20 bp, Artificial sequence
  Synthetic oligonucleotide
aatctagattgtgaccatct

SEQ ID NO: 2341 - DNA, 20 bp, Artificial sequence
  Synthetic oligonucleotide
taatctagattgtgaccatc

SEQ ID NO: 2342 - DNA, 20 bp, Artificial sequence
  Synthetic oligonucleotide
ataatctagattgtgaccat

SEQ ID NO: 2343 - DNA, 20 bp, Artificial sequence
  Synthetic oligonucleotide
tataatctagattgtgacca

SEQ ID NO: 2344 - DNA, 20 bp, Artificial sequence
  Synthetic oligonucleotide
ttataatctagattgtgacc

SEQ ID NO: 2345 - DNA, 20 bp, Artificial sequence
  Synthetic oligonucleotide
tgattataatctagattgtg

SEQ ID NO: 2346 - DNA, 20 bp, Artificial sequence
  Synthetic oligonucleotide
ttgattataatctagattgt

SEQ ID NO: 2347 - DNA, 20 bp, Artificial sequence
  Synthetic oligonucleotide
attgattataatctagattg

SEQ ID NO: 2348 - DNA, 20 bp, Artificial sequence
  Synthetic oligonucleotide
tattgattataatctagatt

SEQ ID NO: 2349 - DNA, 20 bp, Artificial sequence
  Synthetic oligonucleotide
ctattgattataatctagat

SEQ ID NO: 2350 - DNA, 20 bp, Artificial sequence
  Synthetic oligonucleotide
cctattgattataatctaga

SEQ ID NO: 2351 - DNA, 20 bp, Artificial sequence
  Synthetic oligonucleotide
acctattgattataatctag

SEQ ID NO: 2352 - DNA, 20 bp, Artificial sequence
  Synthetic oligonucleotide
cacctattgattataatcta

SEQ ID NO: 2353 - DNA, 20 bp, Artificial sequence
  Synthetic oligonucleotide
tcacctattgattataatct

SEQ ID NO: 2354 - DNA, 20 bp, Artificial sequence
  Synthetic oligonucleotide
ttcacctattgattataatc

SEQ ID NO: 2355 - DNA, 20 bp, Artificial sequence
  Synthetic oligonucleotide
gttcacctattgattataat

SEQ ID NO: 2356 - DNA, 20 bp, Artificial sequence
  Synthetic oligonucleotide
agttcacctattgattataa

SEQ ID NO: 2357 - DNA, 20 bp, Artificial sequence
  Synthetic oligonucleotide
aagttcacctattgattata

SEQ ID NO: 2358 - DNA, 20 bp, Artificial sequence
  Synthetic oligonucleotide
ataagttcacctattgatta

SEQ ID NO: 2359 - DNA, 20 bp, Artificial sequence
  Synthetic oligonucleotide
aataagttcacctattgatt

SEQ ID NO: 2360 - DNA, 20 bp, Artificial sequence
  Synthetic oligonucleotide
taataagttcacctattgat

SEQ ID NO: 2361 - DNA, 20 bp, Artificial sequence
  Synthetic oligonucleotide
ttaataagttcacctattga

SEQ ID NO: 2362 - DNA, 20 bp, Artificial sequence
  Synthetic oligonucleotide
tgagtattctcgacttacct

SEQ ID NO: 2363 - DNA, 20 bp, Artificial sequence
  Synthetic oligonucleotide
aagtgagtattctcgactta

SEQ ID NO: 2364 - DNA, 20 bp, Artificial sequence
  Synthetic oligonucleotide
attaagtgagtattctcgac

SEQ ID NO: 2365 - DNA, 20 bp, Artificial sequence
  Synthetic oligonucleotide
ccagaattaagtgagtattc

SEQ ID NO: 2366 - DNA, 20 bp, Artificial sequence
  Synthetic oligonucleotide
tgggttgctttcttaccaga

SEQ ID NO: 2367 - DNA, 20 bp, Artificial sequence
  Synthetic oligonucleotide
aaatgggttgctttcttacc

SEQ ID NO: 2368 - DNA, 20 bp, Artificial sequence
  Synthetic oligonucleotide
tacaaatgggttgctttctt

SEQ ID NO: 2369 - DNA, 20 bp, Artificial sequence
  Synthetic oligonucleotide
aagtacaaatgggttgcttt

SEQ ID NO: 2370 - DNA, 20 bp, Artificial sequence
  Synthetic oligonucleotide
gtaaatacaagtacaaatgg

SEQ ID NO: 2371 - DNA, 20 bp, Artificial sequence
  Synthetic oligonucleotide
ttgctggtaaatacaagtac

SEQ ID NO: 2372 - DNA, 20 bp, Artificial sequence
  Synthetic oligonucleotide
taaggattgctggtaaatac

SEQ ID NO: 2373 - DNA, 20 bp, Artificial sequence
  Synthetic oligonucleotide
ttttaaggattgctggtaaa

SEQ ID NO: 2374 - DNA, 20 bp, Artificial sequence
  Synthetic oligonucleotide
gaagcttcattttaaggatt

SEQ ID NO: 2375 - DNA, 20 bp, Artificial sequence
  Synthetic oligonucleotide
taggaagcttcattttaagg

SEQ ID NO: 2376 - DNA, 20 bp, Artificial sequence
  Synthetic oligonucleotide
tagtaggaagcttcatttta

SEQ ID NO: 2377 - DNA, 20 bp, Artificial sequence
  Synthetic oligonucleotide
ttgagttagtaggaagcttc

SEQ ID NO: 2378 - DNA, 20 bp, Artificial sequence
  Synthetic oligonucleotide
attgctattgagttagtagg

SEQ ID NO: 2379 - DNA, 20 bp, Artificial sequence
  Synthetic oligonucleotide
cttattgctattgagttagt

SEQ ID NO: 2380 - DNA, 20 bp, Artificial sequence
  Synthetic oligonucleotide
attgtcttattgctattgag

SEQ ID NO: 2381 - DNA, 20 bp, Artificial sequence
  Synthetic oligonucleotide
actattgtcttattgctatt

SEQ ID NO: 2382 - DNA, 20 bp, Artificial sequence
  Synthetic oligonucleotide
ttcactattgtcttattgct

SEQ ID NO: 2383 - DNA, 20 bp, Artificial sequence
  Synthetic oligonucleotide
acattcactattgtcttatt

SEQ ID NO: 2384 - DNA, 20 bp, Artificial sequence
  Synthetic oligonucleotide
taaacattcactattgtctt

SEQ ID NO: 2385 - DNA, 20 bp, Artificial sequence
  Synthetic oligonucleotide
cattaaacattcactattgt

SEQ ID NO: 2386 - DNA, 20 bp, Artificial sequence
  Synthetic oligonucleotide
gttttcattaaacattcact

SEQ ID NO: 2387 - DNA, 20 bp, Artificial sequence
  Synthetic oligonucleotide
aaatactgttttcattaaac

SEQ ID NO: 2388 - DNA, 20 bp, Artificial sequence
  Synthetic oligonucleotide
aaagtatttataaaatactg

SEQ ID NO: 2389 - DNA, 20 bp, Artificial sequence
  Synthetic oligonucleotide
cctttttattaaagtattta

SEQ ID NO: 2390 - DNA, 20 bp, Artificial sequence
  Synthetic oligonucleotide
caatcctttttattaaagta

SEQ ID NO: 2391 - DNA, 20 bp, Artificial sequence
  Synthetic oligonucleotide
cttcatcacaatccttttta

SEQ ID NO: 2392 - DNA, 20 bp, Artificial sequence
  Synthetic oligonucleotide
gttcttcatcacaatccttt

SEQ ID NO: 2393 - DNA, 20 bp, Artificial sequence
  Synthetic oligonucleotide
attgttcttcatcacaatcc

SEQ ID NO: 2394 - DNA, 20 bp, Artificial sequence
  Synthetic oligonucleotide
tagattgttcttcatcacaa

SEQ ID NO: 2395 - DNA, 20 bp, Artificial sequence
  Synthetic oligonucleotide
aaatagattgttcttcatca

SEQ ID NO: 2396 - DNA, 20 bp, Artificial sequence
  Synthetic oligonucleotide
aacaaatataaatagattgt

SEQ ID NO: 2397 - DNA, 20 bp, Artificial sequence
  Synthetic oligonucleotide
caaataacaaatataaatag

SEQ ID NO: 2398 - DNA, 20 bp, Artificial sequence
  Synthetic oligonucleotide
tggaattaaaaacaaataac

SEQ ID NO: 2399 - DNA, 20 bp, Artificial sequence
  Synthetic oligonucleotide
ttattggaattaaaaacaaa

SEQ ID NO: 2400 - DNA, 20 bp, Artificial sequence
  Synthetic oligonucleotide
tttttattggaattaaaaac

SEQ ID NO: 2401 - DNA, 20 bp, Artificial sequence
  Synthetic oligonucleotide
taataacttttttctgtaat

SEQ ID NO: 2402 - DNA, 20 bp, Artificial sequence
  Synthetic oligonucleotide
gttcttaataacttttttct

SEQ ID NO: 2403 - DNA, 20 bp, Artificial sequence
  Synthetic oligonucleotide
aaaagcatggttcttaataa

SEQ ID NO: 2404 - DNA, 20 bp, Artificial sequence
  Synthetic oligonucleotide
aaatttaaaagcatggttct

SEQ ID NO: 2405 - DNA, 20 bp, Artificial sequence
  Synthetic oligonucleotide
aggaataaatttaaaaaatc

SEQ ID NO: 2406 - DNA, 20 bp, Artificial sequence
  Synthetic oligonucleotide
agacaggaataaatttaaaa

SEQ ID NO: 2407 - DNA, 20 bp, Artificial sequence
  Synthetic oligonucleotide
aaaagacaggaataaattta

SEQ ID NO: 2408 - DNA, 20 bp, Artificial sequence
  Synthetic oligonucleotide
ctttctttgtagaaaaagac

SEQ ID NO: 2409 - DNA, 20 bp, Artificial sequence
  Synthetic oligonucleotide
atgctttctttgtagaaaaa

SEQ ID NO: 2410 - DNA, 20 bp, Artificial sequence
  Synthetic oligonucleotide
tttgcttaatgtatgctttc

SEQ ID NO: 2411 - DNA, 20 bp, Artificial sequence
  Synthetic oligonucleotide
gtatttgcttaatgtatgct

SEQ ID NO: 2412 - DNA, 20 bp, Artificial sequence
  Synthetic oligonucleotide
ttggtatttgcttaatgtat

SEQ ID NO: 2413 - DNA, 20 bp, Artificial sequence
  Synthetic oligonucleotide
cctttggtatttgcttaatg

SEQ ID NO: 2414 - DNA, 20 bp, Artificial sequence
  Synthetic oligonucleotide
tggcctttggtatttgctta

SEQ ID NO: 2415 - DNA, 20 bp, Artificial sequence
  Synthetic oligonucleotide
taaacctggcctttggtatt

SEQ ID NO: 2416 - DNA, 20 bp, Artificial sequence
  Synthetic oligonucleotide
atgtaaacctggcctttggt

SEQ ID NO: 2417 - DNA, 20 bp, Artificial sequence
  Synthetic oligonucleotide
caaatgtaaacctggccttt

SEQ ID NO: 2418 - DNA, 20 bp, Artificial sequence
  Synthetic oligonucleotide
cttcaaatgtaaacctggcc

SEQ ID NO: 2419 - DNA, 20 bp, Artificial sequence
  Synthetic oligonucleotide
tttcttcaaatgtaaacctg

SEQ ID NO: 2420 - DNA, 20 bp, Artificial sequence
  Synthetic oligonucleotide
tgtcactttcttcaaatgta

SEQ ID NO: 2421 - DNA, 20 bp, Artificial sequence
  Synthetic oligonucleotide
taatgtcactttcttcaaat

SEQ ID NO: 2422 - DNA, 20 bp, Artificial sequence
  Synthetic oligonucleotide
aataataatgtcactttctt

SEQ ID NO: 2423 - DNA, 20 bp, Artificial sequence
  Synthetic oligonucleotide
gagtaataataatgtcactt

SEQ ID NO: 2424 - DNA, 20 bp, Artificial sequence
  Synthetic oligonucleotide
gacttgagtaataataatgt

SEQ ID NO: 2425 - DNA, 20 bp, Artificial sequence
  Synthetic oligonucleotide
cctagagacttgagtaataa

SEQ ID NO: 2426 - DNA, 20 bp, Artificial sequence
  Synthetic oligonucleotide
attcctagagacttgagtaa

SEQ ID NO: 2427 - DNA, 20 bp, Artificial sequence
  Synthetic oligonucleotide
aagtattcctagagacttga

SEQ ID NO: 2428 - DNA, 20 bp, Artificial sequence
  Synthetic oligonucleotide
tgtgttaagtattcctagag

SEQ ID NO: 2429 - DNA, 20 bp, Artificial sequence
  Synthetic oligonucleotide
agagatgtgttaagtattcc

SEQ ID NO: 2430 - DNA, 20 bp, Artificial sequence
  Synthetic oligonucleotide
gtcaagagatgtgttaagta

SEQ ID NO: 2431 - DNA, 20 bp, Artificial sequence
  Synthetic oligonucleotide
acagtcaagagatgtgttaa

SEQ ID NO: 2432 - DNA, 20 bp, Artificial sequence
  Synthetic oligonucleotide
tatacagtcaagagatgtgt

SEQ ID NO: 2433 - DNA, 20 bp, Artificial sequence
  Synthetic oligonucleotide
ccatatacagtcaagagatg

SEQ ID NO: 2434 - DNA, 20 bp, Artificial sequence
  Synthetic oligonucleotide
gtaagttgaactaactactg

SEQ ID NO: 2435 - DNA, 20 bp, Artificial sequence
  Synthetic oligonucleotide
tgagtaagttgaactaacta

SEQ ID NO: 2436 - DNA, 20 bp, Artificial sequence
  Synthetic oligonucleotide
taatgagtaagttgaactaa

SEQ ID NO: 2437 - DNA, 20 bp, Artificial sequence
  Synthetic oligonucleotide
aggttaatcttcctaatacg

SEQ ID NO: 2438 - DNA, 20 bp, Artificial sequence
  Synthetic oligonucleotide
ataaccaggttaatcttcct

SEQ ID NO: 2439 - DNA, 20 bp, Artificial sequence
  Synthetic oligonucleotide
atgataaccaggttaatctt

SEQ ID NO: 2440 - DNA, 20 bp, Artificial sequence
  Synthetic oligonucleotide
aacaatgataaccaggttaa

SEQ ID NO: 2441 - DNA, 20 bp, Artificial sequence
  Synthetic oligonucleotide
taaaacaatgataaccaggt

SEQ ID NO: 2442 - DNA, 20 bp, Artificial sequence
  Synthetic oligonucleotide
gtataaaacaatgataacca

SEQ ID NO: 2443 - DNA, 20 bp, Artificial sequence
  Synthetic oligonucleotide
cgaatactcatatatatttc

SEQ ID NO: 2444 - DNA, 20 bp, Artificial sequence
  Synthetic oligonucleotide
atacgaatactcatatatat

SEQ ID NO: 2445 - DNA, 20 bp, Artificial sequence
  Synthetic oligonucleotide
tttatacgaatactcatata

SEQ ID NO: 2446 - DNA, 20 bp, Artificial sequence
  Synthetic oligonucleotide
atatttatacgaatactcat

SEQ ID NO: 2447 - DNA, 20 bp, Artificial sequence
  Synthetic oligonucleotide
gtattatatttatacgaata

SEQ ID NO: 2448 - DNA, 20 bp, Artificial sequence
  Synthetic oligonucleotide
aaaagtattatatttatacg

SEQ ID NO: 2449 - DNA, 20 bp, Artificial sequence
  Synthetic oligonucleotide
ggtaaaagtattatatttat

SEQ ID NO: 2450 - DNA, 20 bp, Artificial sequence
  Synthetic oligonucleotide
acaaggtaaaagtattatat

SEQ ID NO: 2451 - DNA, 20 bp, Artificial sequence
  Synthetic oligonucleotide
taaacaaggtaaaagtatta

SEQ ID NO: 2452 - DNA, 20 bp, Artificial sequence
  Synthetic oligonucleotide
acataaacaaggtaaaagta

SEQ ID NO: 2453 - DNA, 20 bp, Artificial sequence
  Synthetic oligonucleotide
ttgagtaaatacataaacaa

SEQ ID NO: 2454 - DNA, 20 bp, Artificial sequence
  Synthetic oligonucleotide
gagaatattgagtaaataca

SEQ ID NO: 2455 - DNA, 20 bp, Artificial sequence
  Synthetic oligonucleotide
aaggagaatattgagtaaat

SEQ ID NO: 2456 - DNA, 20 bp, Artificial sequence
  Synthetic oligonucleotide
gaaaaggagaatattgagta

SEQ ID NO: 2457 - DNA, 20 bp, Artificial sequence
  Synthetic oligonucleotide
gaggaaaaggagaatattga

SEQ ID NO: 2458 - DNA, 20 bp, Artificial sequence
  Synthetic oligonucleotide
ttagaggaaaaggagaatat

SEQ ID NO: 2459 - DNA, 20 bp, Artificial sequence
  Synthetic oligonucleotide
attattttagaggaaaagga

SEQ ID NO: 2460 - DNA, 20 bp, Artificial sequence
  Synthetic oligonucleotide
cagattattttagaggaaaa

SEQ ID NO: 2461 - DNA, 20 bp, Artificial sequence
  Synthetic oligonucleotide
cttcagattattttagagga

SEQ ID NO: 2462 - DNA, 20 bp, Artificial sequence
  Synthetic oligonucleotide
tagtcacttcagattatttt

SEQ ID NO: 2463 - DNA, 20 bp, Artificial sequence
  Synthetic oligonucleotide
taatagtcacttcagattat

SEQ ID NO: 2464 - DNA, 20 bp, Artificial sequence
  Synthetic oligonucleotide
tgataatagtcacttcagat

SEQ ID NO: 2465 - DNA, 20 bp, Artificial sequence
  Synthetic oligonucleotide
tattgataatagtcacttca

SEQ ID NO: 2466 - DNA, 20 bp, Artificial sequence
  Synthetic oligonucleotide
acttattgataatagtcact

SEQ ID NO: 2467 - DNA, 20 bp, Artificial sequence
  Synthetic oligonucleotide
taaacttattgataatagtc

SEQ ID NO: 2468 - DNA, 20 bp, Artificial sequence
  Synthetic oligonucleotide
tagtaaacttattgataata

SEQ ID NO: 2469 - DNA, 20 bp, Artificial sequence
  Synthetic oligonucleotide
gcatagtaaacttattgata

SEQ ID NO: 2470 - DNA, 20 bp, Artificial sequence
  Synthetic oligonucleotide
ttggcatagtaaacttattg

SEQ ID NO: 2471 - DNA, 20 bp, Artificial sequence
  Synthetic oligonucleotide
attttggcatagtaaactta

SEQ ID NO: 2472 - DNA, 20 bp, Artificial sequence
  Synthetic oligonucleotide
tgaattttggcatagtaaac

SEQ ID NO: 2473 - DNA, 20 bp, Artificial sequence
  Synthetic oligonucleotide
ttaatgaattttggcatagt

SEQ ID NO: 2474 - DNA, 20 bp, Artificial sequence
  Synthetic oligonucleotide
caattaatgaattttggcat

SEQ ID NO: 2475 - DNA, 20 bp, Artificial sequence
  Synthetic oligonucleotide
aaaggcaattaatgaatttt

SEQ ID NO: 2476 - DNA, 20 bp, Artificial sequence
  Synthetic oligonucleotide
gtgaaaggcaattaatgaat

SEQ ID NO: 2477 - DNA, 20 bp, Artificial sequence
  Synthetic oligonucleotide
ttaagtgaaaggcaattaat

SEQ ID NO: 2478 - DNA, 20 bp, Artificial sequence
  Synthetic oligonucleotide
aagttaagtgaaaggcaatt

SEQ ID NO: 2479 - DNA, 20 bp, Artificial sequence
  Synthetic oligonucleotide
ccaaaagttaagtgaaaggc

SEQ ID NO: 2480 - DNA, 20 bp, Artificial sequence
  Synthetic oligonucleotide
gtcccaaaagttaagtgaaa

SEQ ID NO: 2481 - DNA, 20 bp, Artificial sequence
  Synthetic oligonucleotide
atggtcccaaaagttaagtg

SEQ ID NO: 2482 - DNA, 20 bp, Artificial sequence
  Synthetic oligonucleotide
attatggtcccaaaagttaa

SEQ ID NO: 2483 - DNA, 20 bp, Artificial sequence
  Synthetic oligonucleotide
tttattatggtcccaaaagt

SEQ ID NO: 2484 - DNA, 20 bp, Artificial sequence
  Synthetic oligonucleotide
ttattatttattatggtccc

SEQ ID NO: 2485 - DNA, 20 bp, Artificial sequence
  Synthetic oligonucleotide
atggcaatacattttattat

SEQ ID NO: 2486 - DNA, 20 bp, Artificial sequence
  Synthetic oligonucleotide
gttatggcaatacattttat

SEQ ID NO: 2487 - DNA, 20 bp, Artificial sequence
  Synthetic oligonucleotide
taatgttatggcaatacatt

SEQ ID NO: 2488 - DNA, 20 bp, Artificial sequence
  Synthetic oligonucleotide
tattaatgttatggcaatac

SEQ ID NO: 2489 - DNA, 20 bp, Artificial sequence
  Synthetic oligonucleotide
gtttattaatgttatggcaa

SEQ ID NO: 2490 - DNA, 20 bp, Artificial sequence
  Synthetic oligonucleotide
gtagtttattaatgttatgg

SEQ ID NO: 2491 - DNA, 20 bp, Artificial sequence
  Synthetic oligonucleotide
aaggtagtttattaatgtta

SEQ ID NO: 2492 - DNA, 20 bp, Artificial sequence
  Synthetic oligonucleotide
tgtaaggtagtttattaatg

SEQ ID NO: 2493 - DNA, 20 bp, Artificial sequence
  Synthetic oligonucleotide
ttttgtaaggtagtttatta

SEQ ID NO: 2494 - DNA, 20 bp, Artificial sequence
  Synthetic oligonucleotide
tggttttgtaaggtagttta

SEQ ID NO: 2495 - DNA, 20 bp, Artificial sequence
  Synthetic oligonucleotide
tggtggttttgtaaggtagt

SEQ ID NO: 2496 - DNA, 20 bp, Artificial sequence
  Synthetic oligonucleotide
aattggtggttttgtaaggt

SEQ ID NO: 2497 - DNA, 20 bp, Artificial sequence
  Synthetic oligonucleotide
tttaattggtggttttgtaa

SEQ ID NO: 2498 - DNA, 20 bp, Artificial sequence
  Synthetic oligonucleotide
ttgattttaattggtggttt

SEQ ID NO: 2499 - DNA, 20 bp, Artificial sequence
  Synthetic oligonucleotide
tgtttgattttaattggtgg

SEQ ID NO: 2500 - DNA, 20 bp, Artificial sequence
  Synthetic oligonucleotide
atgtaaataacacttttttg

SEQ ID NO: 2501 - DNA, 20 bp, Artificial sequence
  Synthetic oligonucleotide
cagatgtaaataacactttt

SEQ ID NO: 2502 - DNA, 20 bp, Artificial sequence
  Synthetic oligonucleotide
tgacagatgtaaataacact

SEQ ID NO: 2503 - DNA, 20 bp, Artificial sequence
  Synthetic oligonucleotide
atgttgacagatgtaaataa

SEQ ID NO: 2504 - DNA, 20 bp, Artificial sequence
  Synthetic oligonucleotide
tttatgttgacagatgtaaa

SEQ ID NO: 2505 - DNA, 20 bp, Artificial sequence
  Synthetic oligonucleotide
agatttatgttgacagatgt

SEQ ID NO: 2506 - DNA, 20 bp, Artificial sequence
  Synthetic oligonucleotide
agtagatttatgttgacaga

SEQ ID NO: 2507 - DNA, 20 bp, Artificial sequence
  Synthetic oligonucleotide
tttagtagatttatgttgac

SEQ ID NO: 2508 - DNA, 20 bp, Artificial sequence
  Synthetic oligonucleotide
atttttagtagatttatgtt

SEQ ID NO: 2509 - DNA, 20 bp, Artificial sequence
  Synthetic oligonucleotide
catgtatttttagtagattt

SEQ ID NO: 2510 - DNA, 20 bp, Artificial sequence
  Synthetic oligonucleotide
gaaatcatgtatttttagta

SEQ ID NO: 2511 - DNA, 20 bp, Artificial sequence
  Synthetic oligonucleotide
attgtatttgatggatatct

SEQ ID NO: 2512 - DNA, 20 bp, Artificial sequence
  Synthetic oligonucleotide
gatacattgtatttgatgga

SEQ ID NO: 2513 - DNA, 20 bp, Artificial sequence
  Synthetic oligonucleotide
taggttgatacattgtattt

SEQ ID NO: 2514 - DNA, 20 bp, Artificial sequence
  Synthetic oligonucleotide
cagtttaggttgatacattg

SEQ ID NO: 2515 - DNA, 20 bp, Artificial sequence
  Synthetic oligonucleotide
gcatccagtttaggttgata

SEQ ID NO: 2516 - DNA, 20 bp, Artificial sequence
  Synthetic oligonucleotide
ccccagcatccagtttaggt

SEQ ID NO: 2517 - DNA, 20 bp, Artificial sequence
  Synthetic oligonucleotide
aagaaccccagcatccagtt

SEQ ID NO: 2518 - DNA, 20 bp, Artificial sequence
  Synthetic oligonucleotide
gtgtaaaaagaaccccagca

SEQ ID NO: 2519 - DNA, 20 bp, Artificial sequence
  Synthetic oligonucleotide
atagggtgtaaaaagaaccc

SEQ ID NO: 2520 - DNA, 20 bp, Artificial sequence
  Synthetic oligonucleotide
cttttatagggtgtaaaaag

SEQ ID NO: 2521 - DNA, 20 bp, Artificial sequence
  Synthetic oligonucleotide
tatgtcttttatagggtgta

SEQ ID NO: 2522 - DNA, 20 bp, Artificial sequence
  Synthetic oligonucleotide
ttaggtatgtcttttatagg

SEQ ID NO: 2523 - DNA, 20 bp, Artificial sequence
  Synthetic oligonucleotide
ttgtcttaggtatgtctttt

SEQ ID NO: 2524 - DNA, 20 bp, Artificial sequence
  Synthetic oligonucleotide
ctctgattgtcttaggtatg

SEQ ID NO: 2525 - DNA, 20 bp, Artificial sequence
  Synthetic oligonucleotide
tatttctctgattgtcttag

SEQ ID NO: 2526 - DNA, 20 bp, Artificial sequence
  Synthetic oligonucleotide
tcaagtccatatttgtattt

SEQ ID NO: 2527 - DNA, 20 bp, Artificial sequence
  Synthetic oligonucleotide
aataatcaagtccatatttg

SEQ ID NO: 2528 - DNA, 20 bp, Artificial sequence
  Synthetic oligonucleotide
ttatctaataatcaagtcca

SEQ ID NO: 2529 - DNA, 20 bp, Artificial sequence
  Synthetic oligonucleotide
ctatattatctaataatcaa

SEQ ID NO: 2530 - DNA, 20 bp, Artificial sequence
  Synthetic oligonucleotide
taaaccttctatattatcta

SEQ ID NO: 2531 - DNA, 20 bp, Artificial sequence
  Synthetic oligonucleotide
aattaataaaccttctatat

SEQ ID NO: 2532 - DNA, 20 bp, Artificial sequence
  Synthetic oligonucleotide
taagtacaggttggacactg

SEQ ID NO: 2533 - DNA, 20 bp, Artificial sequence
  Synthetic oligonucleotide
gttattaagtacaggttgga

SEQ ID NO: 2534 - DNA, 20 bp, Artificial sequence
  Synthetic oligonucleotide
tgtgagttattaagtacagg

SEQ ID NO: 2535 - DNA, 20 bp, Artificial sequence
  Synthetic oligonucleotide
aaatctgtgagttattaagt

SEQ ID NO: 2536 - DNA, 20 bp, Artificial sequence
  Synthetic oligonucleotide
gttttaaaaatctgtgagtt

SEQ ID NO: 2537 - DNA, 20 bp, Artificial sequence
  Synthetic oligonucleotide
caaaattctcctgaaaagaa

SEQ ID NO: 2538 - DNA, 20 bp, Artificial sequence
  Synthetic oligonucleotide
cccaaccaaaattctcctga

SEQ ID NO: 2539 - DNA, 20 bp, Artificial sequence
  Synthetic oligonucleotide
acctgaataaccctctggac

SEQ ID NO: 2540 - DNA, 20 bp, Artificial sequence
  Synthetic oligonucleotide
aagatacctgaataaccctc

SEQ ID NO: 2541 - DNA, 20 bp, Artificial sequence
  Synthetic oligonucleotide
agaaaaagatacctgaataa

SEQ ID NO: 2542 - DNA, 20 bp, Artificial sequence
  Synthetic oligonucleotide
tggtatcagaaaaagatacc

SEQ ID NO: 2543 - DNA, 20 bp, Artificial sequence
  Synthetic oligonucleotide
agtattggtatcagaaaaag

SEQ ID NO: 2544 - DNA, 20 bp, Artificial sequence
  Synthetic oligonucleotide
aataaagtattggtatcaga

SEQ ID NO: 2545 - DNA, 20 bp, Artificial sequence
  Synthetic oligonucleotide
atgaaaataaagtattggta

SEQ ID NO: 2546 - DNA, 20 bp, Artificial sequence
  Synthetic oligonucleotide
agatactttgaagatatgaa

SEQ ID NO: 2547 - DNA, 20 bp, Artificial sequence
  Synthetic oligonucleotide
tgggaagatactttgaagat

SEQ ID NO: 2548 - DNA, 20 bp, Artificial sequence
  Synthetic oligonucleotide
ctaataatgtgggaagatac

SEQ ID NO: 2549 - DNA, 20 bp, Artificial sequence
  Synthetic oligonucleotide
cattgcagataatagctaat

SEQ ID NO: 2550 - DNA, 20 bp, Artificial sequence
  Synthetic oligonucleotide
aagttgtcattgcagataat

SEQ ID NO: 2551 - DNA, 20 bp, Artificial sequence
  Synthetic oligonucleotide
ttttaaaagttgtcattgca

SEQ ID NO: 2552 - DNA, 20 bp, Artificial sequence
  Synthetic oligonucleotide
attcggatttttaaaagttg

SEQ ID NO: 2553 - DNA, 20 bp, Artificial sequence
  Synthetic oligonucleotide
ttatttgggattcggatttt

SEQ ID NO: 2554 - DNA, 20 bp, Artificial sequence
  Synthetic oligonucleotide
ttatagttaagaggttttcg

SEQ ID NO: 2555 - DNA, 20 bp, Artificial sequence
  Synthetic oligonucleotide
tttcattatagttaagaggt

SEQ ID NO: 2556 - DNA, 20 bp, Artificial sequence
  Synthetic oligonucleotide
gaacactttcattatagtta

SEQ ID NO: 2557 - DNA, 20 bp, Artificial sequence
  Synthetic oligonucleotide
gaactagaatgaacactttc

SEQ ID NO: 2558 - DNA, 20 bp, Artificial sequence
  Synthetic oligonucleotide
tgattgaactagaatgaaca

SEQ ID NO: 2559 - DNA, 20 bp, Artificial sequence
  Synthetic oligonucleotide
atacctgattgaactagaat

SEQ ID NO: 2560 - DNA, 20 bp, Artificial sequence
  Synthetic oligonucleotide
gtaaaatacctgattgaact

SEQ ID NO: 2561 - DNA, 20 bp, Artificial sequence
  Synthetic oligonucleotide
tagaggtaaaatacctgatt

SEQ ID NO: 2562 - DNA, 20 bp, Artificial sequence
  Synthetic oligonucleotide
aagattagaggtaaaatacc

SEQ ID NO: 2563 - DNA, 20 bp, Artificial sequence
  Synthetic oligonucleotide
tgaggaagattagaggtaaa

SEQ ID NO: 2564 - DNA, 20 bp, Artificial sequence
  Synthetic oligonucleotide
gaaaatctgaggaagattag

SEQ ID NO: 2565 - DNA, 20 bp, Artificial sequence
  Synthetic oligonucleotide
aaatagaaaatctgaggaag

SEQ ID NO: 2566 - DNA, 20 bp, Artificial sequence
  Synthetic oligonucleotide
atctatacactaccaaaaaa

SEQ ID NO: 2567 - DNA, 20 bp, Artificial sequence
  Synthetic oligonucleotide
aaataatctatacactacca

SEQ ID NO: 2568 - DNA, 20 bp, Artificial sequence
  Synthetic oligonucleotide
aaataatctgtataaataat

SEQ ID NO: 2569 - DNA, 20 bp, Artificial sequence
  Synthetic oligonucleotide
cccaattttaaataatctgt

SEQ ID NO: 2570 - DNA, 20 bp, Artificial sequence
  Synthetic oligonucleotide
taagtcccaattttaaataa

SEQ ID NO: 2571 - DNA, 20 bp, Artificial sequence
  Synthetic oligonucleotide
tctgtataagtcccaatttt

SEQ ID NO: 2572 - DNA, 20 bp, Artificial sequence
  Synthetic oligonucleotide
aataatctgtataagtccca

SEQ ID NO: 2573 - DNA, 20 bp, Artificial sequence
  Synthetic oligonucleotide
agttttaaataatctgtata

SEQ ID NO: 2574 - DNA, 20 bp, Artificial sequence
  Synthetic oligonucleotide
atcccagttttaaataatct

SEQ ID NO: 2575 - DNA, 20 bp, Artificial sequence
  Synthetic oligonucleotide
catgtatcccagttttaaat

SEQ ID NO: 2576 - DNA, 20 bp, Artificial sequence
  Synthetic oligonucleotide
tagatgcatgtatcccagtt

SEQ ID NO: 2577 - DNA, 20 bp, Artificial sequence
  Synthetic oligonucleotide
tgttttagatgcatgtatcc

SEQ ID NO: 2578 - DNA, 20 bp, Artificial sequence
  Synthetic oligonucleotide
tacagtgttttagatgcatg

SEQ ID NO: 2579 - DNA, 20 bp, Artificial sequence
  Synthetic oligonucleotide
aatattacagtgttttagat

SEQ ID NO: 2580 - DNA, 20 bp, Artificial sequence
  Synthetic oligonucleotide
cttataaatattacagtgtt

SEQ ID NO: 2581 - DNA, 20 bp, Artificial sequence
  Synthetic oligonucleotide
cttcctttcttataaatatt

SEQ ID NO: 2582 - DNA, 20 bp, Artificial sequence
  Synthetic oligonucleotide
tttatcttcctttcttataa

SEQ ID NO: 2583 - DNA, 20 bp, Artificial sequence
  Synthetic oligonucleotide
ttccccgtaagtttatcttc

SEQ ID NO: 2584 - DNA, 20 bp, Artificial sequence
  Synthetic oligonucleotide
tgtatttccccgtaagttta

SEQ ID NO: 2585 - DNA, 20 bp, Artificial sequence
  Synthetic oligonucleotide
gttactgtatttccccgtaa

SEQ ID NO: 2586 - DNA, 20 bp, Artificial sequence
  Synthetic oligonucleotide
tgttttcttctggaagcaga

SEQ ID NO: 2587 - DNA, 20 bp, Artificial sequence
  Synthetic oligonucleotide
cagacctagacttcttaact

SEQ ID NO: 2588 - DNA, 20 bp, Artificial sequence
  Synthetic oligonucleotide
agcagacctagacttcttaa

SEQ ID NO: 2589 - DNA, 20 bp, Artificial sequence
  Synthetic oligonucleotide
ttttcttctggaagcagacc

SEQ ID NO: 2590 - DNA, 20 bp, Artificial sequence
  Synthetic oligonucleotide
aaacatatatacatgcttgt

SEQ ID NO: 2591 - DNA, 20 bp, Artificial sequence
  Synthetic oligonucleotide
ttaaacatatatacatgctt

SEQ ID NO: 2592 - DNA, 20 bp, Artificial sequence
  Synthetic oligonucleotide
gtttattgaattttaaacat

SEQ ID NO: 2593 - DNA, 20 bp, Artificial sequence
  Synthetic oligonucleotide
ttgtttattgaattttaaac

SEQ ID NO: 2594 - DNA, 20 bp, Artificial sequence
  Synthetic oligonucleotide
ctttgtttattgaattttaa

SEQ ID NO: 2595 - DNA, 20 bp, Artificial sequence
  Synthetic oligonucleotide
gtctttgtttattgaatttt

SEQ ID NO: 2596 - DNA, 20 bp, Artificial sequence
  Synthetic oligonucleotide
gggtctttgtttattgaatt

SEQ ID NO: 2597 - DNA, 20 bp, Artificial sequence
  Synthetic oligonucleotide
ctgggtctttgtttattgaa

SEQ ID NO: 2598 - DNA, 20 bp, Artificial sequence
  Synthetic oligonucleotide
gactgggtctttgtttattg

SEQ ID NO: 2599 - DNA, 20 bp, Artificial sequence
  Synthetic oligonucleotide
tttctataatttagggactg

SEQ ID NO: 2600 - DNA, 20 bp, Artificial sequence
  Synthetic oligonucleotide
aatttctataatttagggac

SEQ ID NO: 2601 - DNA, 20 bp, Artificial sequence
  Synthetic oligonucleotide
taaatttctataatttaggg

SEQ ID NO: 2602 - DNA, 20 bp, Artificial sequence
  Synthetic oligonucleotide
caagaataatttaaatttct

SEQ ID NO: 2603 - DNA, 20 bp, Artificial sequence
  Synthetic oligonucleotide
gataaacatgcaagaataat

SEQ ID NO: 2604 - DNA, 20 bp, Artificial sequence
  Synthetic oligonucleotide
tcgataaacatgcaagaata

SEQ ID NO: 2605 - DNA, 20 bp, Artificial sequence
  Synthetic oligonucleotide
tgtcgataaacatgcaagaa

SEQ ID NO: 2606 - DNA, 20 bp, Artificial sequence
  Synthetic oligonucleotide
gatgtcgataaacatgcaag

SEQ ID NO: 2607 - DNA, 20 bp, Artificial sequence
  Synthetic oligonucleotide
gtgatgtcgataaacatgca

SEQ ID NO: 2608 - DNA, 20 bp, Artificial sequence
  Synthetic oligonucleotide
ttgtgatgtcgataaacatg

SEQ ID NO: 2609 - DNA, 20 bp, Artificial sequence
  Synthetic oligonucleotide
tgttgtgatgtcgataaaca

SEQ ID NO: 2610 - DNA, 20 bp, Artificial sequence
  Synthetic oligonucleotide
tctgttgtgatgtcgataaa

SEQ ID NO: 2611 - DNA, 20 bp, Artificial sequence
  Synthetic oligonucleotide
gatctgttgtgatgtcgata

SEQ ID NO: 2612 - DNA, 20 bp, Artificial sequence
  Synthetic oligonucleotide
gggatctgttgtgatgtcga

SEQ ID NO: 2613 - DNA, 20 bp, Artificial sequence
  Synthetic oligonucleotide
tagggatctgttgtgatgtc

SEQ ID NO: 2614 - DNA, 20 bp, Artificial sequence
  Synthetic oligonucleotide
tttagggatctgttgtgatg

SEQ ID NO: 2615 - DNA, 20 bp, Artificial sequence
  Synthetic oligonucleotide
gatttagggatctgttgtga

SEQ ID NO: 2616 - DNA, 20 bp, Artificial sequence
  Synthetic oligonucleotide
atctaatctttagggattta

SEQ ID NO: 2617 - DNA, 20 bp, Artificial sequence
  Synthetic oligonucleotide
tttgtatctaatctttaggg

SEQ ID NO: 2618 - DNA, 20 bp, Artificial sequence
  Synthetic oligonucleotide
aatttgtatctaatctttag

SEQ ID NO: 2619 - DNA, 20 bp, Artificial sequence
  Synthetic oligonucleotide
gtggtaaaaaatttgtatct

SEQ ID NO: 2620 - DNA, 20 bp, Artificial sequence
  Synthetic oligonucleotide
ctgtggtaaaaaatttgtat

SEQ ID NO: 2621 - DNA, 20 bp, Artificial sequence
  Synthetic oligonucleotide
tactgtggtaaaaaatttgt

SEQ ID NO: 2622 - DNA, 20 bp, Artificial sequence
  Synthetic oligonucleotide
gatactgtggtaaaaaattt

SEQ ID NO: 2623 - DNA, 20 bp, Artificial sequence
  Synthetic oligonucleotide
agtgatactgtggtaaaaaa

SEQ ID NO: 2624 - DNA, 20 bp, Artificial sequence
  Synthetic oligonucleotide
caagtgatactgtggtaaaa

SEQ ID NO: 2625 - DNA, 20 bp, Artificial sequence
  Synthetic oligonucleotide
gacaagtgatactgtggtaa

SEQ ID NO: 2626 - DNA, 20 bp, Artificial sequence
  Synthetic oligonucleotide
ctgacaagtgatactgtggt

SEQ ID NO: 2627 - DNA, 20 bp, Artificial sequence
  Synthetic oligonucleotide
ttctgacaagtgatactgtg

SEQ ID NO: 2628 - DNA, 20 bp, Artificial sequence
  Synthetic oligonucleotide
aattctgacaagtgatactg

SEQ ID NO: 2629 - DNA, 20 bp, Artificial sequence
  Synthetic oligonucleotide
ataaattctgacaagtgata

SEQ ID NO: 2630 - DNA, 20 bp, Artificial sequence
  Synthetic oligonucleotide
ctggcagttttaaaaaatca

SEQ ID NO: 2631 - DNA, 20 bp, Artificial sequence
  Synthetic oligonucleotide
ttcttactggcagttttaaa

SEQ ID NO: 2632 - DNA, 20 bp, Artificial sequence
  Synthetic oligonucleotide
atttcttactggcagtttta

SEQ ID NO: 2633 - DNA, 20 bp, Artificial sequence
  Synthetic oligonucleotide
aaatttcttactggcagttt

SEQ ID NO: 2634 - DNA, 20 bp, Artificial sequence
  Synthetic oligonucleotide
tttaaaatttcttactggca

SEQ ID NO: 2635 - DNA, 20 bp, Artificial sequence
  Synthetic oligonucleotide
ttaatttaaaatttcttact

SEQ ID NO: 2636 - DNA, 20 bp, Artificial sequence
  Synthetic oligonucleotide
caaatgggtttaatttaaaa

SEQ ID NO: 2637 - DNA, 20 bp, Artificial sequence
  Synthetic oligonucleotide
aacaaatgggtttaatttaa

SEQ ID NO: 2638 - DNA, 20 bp, Artificial sequence
  Synthetic oligonucleotide
ttaacaaatgggtttaattt

SEQ ID NO: 2639 - DNA, 20 bp, Artificial sequence
  Synthetic oligonucleotide
ctttaacaaatgggtttaat

SEQ ID NO: 2640 - DNA, 20 bp, Artificial sequence
  Synthetic oligonucleotide
tcctttaacaaatgggttta

SEQ ID NO: 2641 - DNA, 20 bp, Artificial sequence
  Synthetic oligonucleotide
ctatatcctttaacaaatgg

SEQ ID NO: 2642 - DNA, 20 bp, Artificial sequence
  Synthetic oligonucleotide
gggcactatatcctttaaca

SEQ ID NO: 2643 - DNA, 20 bp, Artificial sequence
  Synthetic oligonucleotide
ttgggcactatatcctttaa

SEQ ID NO: 2644 - DNA, 20 bp, Artificial sequence
  Synthetic oligonucleotide
tataacttgggcactatatc

SEQ ID NO: 2645 - DNA, 20 bp, Artificial sequence
  Synthetic oligonucleotide
catataacttgggcactata

SEQ ID NO: 2646 - DNA, 20 bp, Artificial sequence
  Synthetic oligonucleotide
tcaccatataacttgggcac

SEQ ID NO: 2647 - DNA, 20 bp, Artificial sequence
  Synthetic oligonucleotide
taggtcaccatataacttgg

SEQ ID NO: 2648 - DNA, 20 bp, Artificial sequence
  Synthetic oligonucleotide
ggtaggtcaccatataactt

SEQ ID NO: 2649 - DNA, 20 bp, Artificial sequence
  Synthetic oligonucleotide
aaggtaggtcaccatataac

SEQ ID NO: 2650 - DNA, 20 bp, Artificial sequence
  Synthetic oligonucleotide
caaaggtaggtcaccatata

SEQ ID NO: 2651 - DNA, 20 bp, Artificial sequence
  Synthetic oligonucleotide
gtattgacaaaggtaggtca

SEQ ID NO: 2652 - DNA, 20 bp, Artificial sequence
  Synthetic oligonucleotide
aagtattgacaaaggtaggt

SEQ ID NO: 2653 - DNA, 20 bp, Artificial sequence
  Synthetic oligonucleotide
ctaagtattgacaaaggtag

SEQ ID NO: 2654 - DNA, 20 bp, Artificial sequence
  Synthetic oligonucleotide
tgctaagtattgacaaaggt

SEQ ID NO: 2655 - DNA, 20 bp, Artificial sequence
  Synthetic oligonucleotide
aatgctaagtattgacaaag

SEQ ID NO: 2656 - DNA, 20 bp, Artificial sequence
  Synthetic oligonucleotide
cataatgctaagtattgaca

SEQ ID NO: 2657 - DNA, 20 bp, Artificial sequence
  Synthetic oligonucleotide
tacataatgctaagtattga

SEQ ID NO: 2658 - DNA, 20 bp, Artificial sequence
  Synthetic oligonucleotide
aatacataatgctaagtatt

SEQ ID NO: 2659 - DNA, 20 bp, Artificial sequence
  Synthetic oligonucleotide
gaaatacataatgctaagta

SEQ ID NO: 2660 - DNA, 20 bp, Artificial sequence
  Synthetic oligonucleotide
tttgaaatacataatgctaa

SEQ ID NO: 2661 - DNA, 20 bp, Artificial sequence
  Synthetic oligonucleotide
ggataatttgaaatacataa

SEQ ID NO: 2662 - DNA, 20 bp, Artificial sequence
  Synthetic oligonucleotide
ttggataatttgaaatacat

SEQ ID NO: 2663 - DNA, 20 bp, Artificial sequence
  Synthetic oligonucleotide
tattggataatttgaaatac

SEQ ID NO: 2664 - DNA, 20 bp, Artificial sequence
  Synthetic oligonucleotide
atccagttaaagcttgtaaa

SEQ ID NO: 2665 - DNA, 20 bp, Artificial sequence
  Synthetic oligonucleotide
tcatgatccagttaaagctt

SEQ ID NO: 2666 - DNA, 20 bp, Artificial sequence
  Synthetic oligonucleotide
tttactcatgatccagttaa

SEQ ID NO: 2667 - DNA, 20 bp, Artificial sequence
  Synthetic oligonucleotide
gataattttactcatgatcc

SEQ ID NO: 2668 - DNA, 20 bp, Artificial sequence
  Synthetic oligonucleotide
gatgtgataattttactcat

SEQ ID NO: 2669 - DNA, 20 bp, Artificial sequence
  Synthetic oligonucleotide
atgctgatgtgataatttta

SEQ ID NO: 2670 - DNA, 20 bp, Artificial sequence
  Synthetic oligonucleotide
cagttatgctgatgtgataa

SEQ ID NO: 2671 - DNA, 20 bp, Artificial sequence
  Synthetic oligonucleotide
tttaacagttatgctgatgt

SEQ ID NO: 2672 - DNA, 20 bp, Artificial sequence
  Synthetic oligonucleotide
gcaattttaacagttatgct

SEQ ID NO: 2673 - DNA, 20 bp, Artificial sequence
  Synthetic oligonucleotide
agagcctgcaattttaacag

SEQ ID NO: 2674 - DNA, 20 bp, Artificial sequence
  Synthetic oligonucleotide
gcttcagagcctgcaatttt

SEQ ID NO: 2675 - DNA, 20 bp, Artificial sequence
  Synthetic oligonucleotide
tattagcttcagagcctgca

SEQ ID NO: 2676 - DNA, 20 bp, Artificial sequence
  Synthetic oligonucleotide
tagtttattagcttcagagc

SEQ ID NO: 2677 - DNA, 20 bp, Artificial sequence
  Synthetic oligonucleotide
gcaggtagtttattagcttc

SEQ ID NO: 2678 - DNA, 20 bp, Artificial sequence
  Synthetic oligonucleotide
taaatgcaggtagtttatta

SEQ ID NO: 2679 - DNA, 20 bp, Artificial sequence
  Synthetic oligonucleotide
atggtttaaatgcaggtagt

SEQ ID NO: 2680 - DNA, 20 bp, Artificial sequence
  Synthetic oligonucleotide
gagccatggtttaaatgcag

SEQ ID NO: 2681 - DNA, 20 bp, Artificial sequence
  Synthetic oligonucleotide
ttttagagccatggtttaaa

SEQ ID NO: 2682 - DNA, 20 bp, Artificial sequence
  Synthetic oligonucleotide
caaagttttagagccatggt

SEQ ID NO: 2683 - DNA, 20 bp, Artificial sequence
  Synthetic oligonucleotide
tcacacaaagttttagagcc

SEQ ID NO: 2684 - DNA, 20 bp, Artificial sequence
  Synthetic oligonucleotide
caaggtcacacaaagtttta

SEQ ID NO: 2685 - DNA, 20 bp, Artificial sequence
  Synthetic oligonucleotide
gggtgaagtaatttattcaa

SEQ ID NO: 2686 - DNA, 20 bp, Artificial sequence
  Synthetic oligonucleotide
gtgaggaaactgagagataa

SEQ ID NO: 2687 - DNA, 20 bp, Artificial sequence
  Synthetic oligonucleotide
tgtagtatatgtgaggaaac

SEQ ID NO: 2688 - DNA, 20 bp, Artificial sequence
  Synthetic oligonucleotide
atctttgtagtatatgtgag

SEQ ID NO: 2689 - DNA, 20 bp, Artificial sequence
  Synthetic oligonucleotide
ttattatctttgtagtatat

SEQ ID NO: 2690 - DNA, 20 bp, Artificial sequence
  Synthetic oligonucleotide
ttctgttattatctttgtag

SEQ ID NO: 2691 - DNA, 20 bp, Artificial sequence
  Synthetic oligonucleotide
ataagttctgttattatctt

SEQ ID NO: 2692 - DNA, 20 bp, Artificial sequence
  Synthetic oligonucleotide
atcctataagttctgttatt

SEQ ID NO: 2693 - DNA, 20 bp, Artificial sequence
  Synthetic oligonucleotide
caataatcctataagttctg

SEQ ID NO: 2694 - DNA, 20 bp, Artificial sequence
  Synthetic oligonucleotide
taagatgacattggctgcta

SEQ ID NO: 2695 - DNA, 20 bp, Artificial sequence
  Synthetic oligonucleotide
tttagtaagatgacattggc

SEQ ID NO: 2696 - DNA, 20 bp, Artificial sequence
  Synthetic oligonucleotide
ttgaattttagtaagatgac

SEQ ID NO: 2697 - DNA, 20 bp, Artificial sequence
  Synthetic oligonucleotide
ctaatttgaattttagtaag

SEQ ID NO: 2698 - DNA, 20 bp, Artificial sequence
  Synthetic oligonucleotide
catgatctaatttgaatttt

SEQ ID NO: 2699 - DNA, 20 bp, Artificial sequence
  Synthetic oligonucleotide
caaagagaaacatgatctaa

SEQ ID NO: 2700 - DNA, 20 bp, Artificial sequence
  Synthetic oligonucleotide
gttttgagcaaagagaaaca

SEQ ID NO: 2701 - DNA, 20 bp, Artificial sequence
  Synthetic oligonucleotide
gtgtggttttgagcaaagag

SEQ ID NO: 2702 - DNA, 20 bp, Artificial sequence
  Synthetic oligonucleotide
agctattgtgtggttttgag

SEQ ID NO: 2703 - DNA, 20 bp, Artificial sequence
  Synthetic oligonucleotide
tgaaatggaaagctattgtg

SEQ ID NO: 2704 - DNA, 20 bp, Artificial sequence
  Synthetic oligonucleotide
tatgagtgaaatggaaagct

SEQ ID NO: 2705 - DNA, 20 bp, Artificial sequence
  Synthetic oligonucleotide
aaagagccaatatgagtgaa

SEQ ID NO: 2706 - DNA, 20 bp, Artificial sequence
  Synthetic oligonucleotide
ttggtctaaagagccaatat

SEQ ID NO: 2707 - DNA, 20 bp, Artificial sequence
  Synthetic oligonucleotide
ggtaatcttggtctaaagag

SEQ ID NO: 2708 - DNA, 20 bp, Artificial sequence
  Synthetic oligonucleotide
gtgagatgacgaagggttgg

SEQ ID NO: 2709 - DNA, 20 bp, Artificial sequence
  Synthetic oligonucleotide
agtcagtgagatgacgaagg

SEQ ID NO: 2710 - DNA, 20 bp, Artificial sequence
  Synthetic oligonucleotide
ggtgaagtcagtgagatgac

SEQ ID NO: 2711 - DNA, 20 bp, Artificial sequence
  Synthetic oligonucleotide
gtagaggaggtgaagtcagt

SEQ ID NO: 2712 - DNA, 20 bp, Artificial sequence
  Synthetic oligonucleotide
aactagagtagaggaggtga

SEQ ID NO: 2713 - DNA, 20 bp, Artificial sequence
  Synthetic oligonucleotide
agaataactagagtagagga

SEQ ID NO: 2714 - DNA, 20 bp, Artificial sequence
  Synthetic oligonucleotide
cggtcagaataactagagta

SEQ ID NO: 2715 - DNA, 20 bp, Artificial sequence
  Synthetic oligonucleotide
taaagcggtcagaataacta

SEQ ID NO: 2716 - DNA, 20 bp, Artificial sequence
  Synthetic oligonucleotide
actggtaaagcggtcagaat

SEQ ID NO: 2717 - DNA, 20 bp, Artificial sequence
  Synthetic oligonucleotide
tgaatactggtaaagcggtc

SEQ ID NO: 2718 - DNA, 20 bp, Artificial sequence
  Synthetic oligonucleotide
tgtgtttgaatactggtaaa

SEQ ID NO: 2719 - DNA, 20 bp, Artificial sequence
  Synthetic oligonucleotide
agtatgtttgatgtgtttga

SEQ ID NO: 2720 - DNA, 20 bp, Artificial sequence
  Synthetic oligonucleotide
gtggcagtatgtttgatgtg

SEQ ID NO: 2721 - DNA, 20 bp, Artificial sequence
  Synthetic oligonucleotide
ttgaggtggcagtatgtttg

SEQ ID NO: 2722 - DNA, 20 bp, Artificial sequence
  Synthetic oligonucleotide
aggctttgaggtggcagtat

SEQ ID NO: 2723 - DNA, 20 bp, Artificial sequence
  Synthetic oligonucleotide
ggcaaaggctttgaggtggc

SEQ ID NO: 2724 - DNA, 20 bp, Artificial sequence
  Synthetic oligonucleotide
aacaagggcaaaggctttga

SEQ ID NO: 2725 - DNA, 20 bp, Artificial sequence
  Synthetic oligonucleotide
tagaggaaacaacaagggca

SEQ ID NO: 2726 - DNA, 20 bp, Artificial sequence
  Synthetic oligonucleotide
ccagttagaggaaacaacaa

SEQ ID NO: 2727 - DNA, 20 bp, Artificial sequence
  Synthetic oligonucleotide
gataccagggcagaagagcg

SEQ ID NO: 2728 - DNA, 20 bp, Artificial sequence
  Synthetic oligonucleotide
aaatcagagagtgggccacg

SEQ ID NO: 2729 - DNA, 20 bp, Artificial sequence
  Synthetic oligonucleotide
cctaagggaaatcagagagt

SEQ ID NO: 2730 - DNA, 20 bp, Artificial sequence
  Synthetic oligonucleotide
acgaccctaagggaaatcag

SEQ ID NO: 2731 - DNA, 20 bp, Artificial sequence
  Synthetic oligonucleotide
tgataacgaccctaagggaa

SEQ ID NO: 2732 - DNA, 20 bp, Artificial sequence
  Synthetic oligonucleotide
ttttgtttgataacgaccct

SEQ ID NO: 2733 - DNA, 20 bp, Artificial sequence
  Synthetic oligonucleotide
gtcttcattgggaatttttt

SEQ ID NO: 2734 - DNA, 20 bp, Artificial sequence
  Synthetic oligonucleotide
tgtaagtcttcattgggaat

SEQ ID NO: 2735 - DNA, 20 bp, Artificial sequence
  Synthetic oligonucleotide
gaccttgtaagtcttcattg

SEQ ID NO: 2736 - DNA, 20 bp, Artificial sequence
  Synthetic oligonucleotide
taagtgaccttgtaagtctt

SEQ ID NO: 2737 - DNA, 20 bp, Artificial sequence
  Synthetic oligonucleotide
ttggttaagtgaccttgtaa

SEQ ID NO: 2738 - DNA, 20 bp, Artificial sequence
  Synthetic oligonucleotide
tgatttttggttaagtgacc

SEQ ID NO: 2739 - DNA, 20 bp, Artificial sequence
  Synthetic oligonucleotide
ggttgtgatttttggttaag

SEQ ID NO: 2740 - DNA, 20 bp, Artificial sequence
  Synthetic oligonucleotide
caggcggttgtgatttttgg

SEQ ID NO: 2741 - DNA, 20 bp, Artificial sequence
  Synthetic oligonucleotide
gggaccaggcggttgtgatt

SEQ ID NO: 2742 - DNA, 20 bp, Artificial sequence
  Synthetic oligonucleotide
ctaaggaagtagaagttttc

SEQ ID NO: 2743 - DNA, 20 bp, Artificial sequence
  Synthetic oligonucleotide
agtagctaaggaagtagaag

SEQ ID NO: 2744 - DNA, 20 bp, Artificial sequence
  Synthetic oligonucleotide
caggagaaaagtagctaagg

SEQ ID NO: 2745 - DNA, 20 bp, Artificial sequence
  Synthetic oligonucleotide
gtgtgcaggagaaaagtagc

SEQ ID NO: 2746 - DNA, 20 bp, Artificial sequence
  Synthetic oligonucleotide
taaaggtgagtgtgcaggag

SEQ ID NO: 2747 - DNA, 20 bp, Artificial sequence
  Synthetic oligonucleotide
atgttaaataaaggtgagtg

SEQ ID NO: 2748 - DNA, 20 bp, Artificial sequence
  Synthetic oligonucleotide
atgttatgttaaataaaggt

SEQ ID NO: 2749 - DNA, 20 bp, Artificial sequence
  Synthetic oligonucleotide
aatttatgttatgttaaata

SEQ ID NO: 2750 - DNA, 20 bp, Artificial sequence
  Synthetic oligonucleotide
taactaaaatttatgttatg

SEQ ID NO: 2751 - DNA, 20 bp, Artificial sequence
  Synthetic oligonucleotide
gataaataactaaaatttat

SEQ ID NO: 2752 - DNA, 20 bp, Artificial sequence
  Synthetic oligonucleotide
tttagtgcaggaatagaaga

SEQ ID NO: 2753 - DNA, 20 bp, Artificial sequence
  Synthetic oligonucleotide
aatccctgtattcacagagc

SEQ ID NO: 2754 - DNA, 20 bp, Artificial sequence
  Synthetic oligonucleotide
gaaaaaatccctgtattcac

SEQ ID NO: 2755 - DNA, 20 bp, Artificial sequence
  Synthetic oligonucleotide
taatggaaaaaatccctgta

SEQ ID NO: 2756 - DNA, 20 bp, Artificial sequence
  Synthetic oligonucleotide
aaatatgaagataatggaaa

SEQ ID NO: 2757 - DNA, 20 bp, Artificial sequence
  Synthetic oligonucleotide
ataatggaaaatatgaagat

SEQ ID NO: 2758 - DNA, 20 bp, Artificial sequence
  Synthetic oligonucleotide
tatacaaataatggaaaata

SEQ ID NO: 2759 - DNA, 20 bp, Artificial sequence
  Synthetic oligonucleotide
ttctggagtatatacaaata

SEQ ID NO: 2760 - DNA, 20 bp, Artificial sequence
  Synthetic oligonucleotide
attctatattctggagtata

SEQ ID NO: 2761 - DNA, 20 bp, Artificial sequence
  Synthetic oligonucleotide
ccatacagtattctatattc

SEQ ID NO: 2762 - DNA, 20 bp, Artificial sequence
  Synthetic oligonucleotide
ctgtgtgccatacagtattc

SEQ ID NO: 2763 - DNA, 20 bp, Artificial sequence
  Synthetic oligonucleotide
gcctactgtgtgccatacag

SEQ ID NO: 2764 - DNA, 20 bp, Artificial sequence
  Synthetic oligonucleotide
agaaatgcctactgtgtgcc

SEQ ID NO: 2765 - DNA, 20 bp, Artificial sequence
  Synthetic oligonucleotide
tcaacagaaatgcctactgt

SEQ ID NO: 2766 - DNA, 20 bp, Artificial sequence
  Synthetic oligonucleotide
attaattcaacagaaatgcc

SEQ ID NO: 2767 - DNA, 20 bp, Artificial sequence
  Synthetic oligonucleotide
gacattacatttattaattc

SEQ ID NO: 2768 - DNA, 20 bp, Artificial sequence
  Synthetic oligonucleotide
gtgaatatgacattacattt

SEQ ID NO: 2769 - DNA, 20 bp, Artificial sequence
  Synthetic oligonucleotide
cttctgtgtgaatatgacat

SEQ ID NO: 2770 - DNA, 20 bp, Artificial sequence
  Synthetic oligonucleotide
acacgcttctgtgtgaatat

SEQ ID NO: 2771 - DNA, 20 bp, Artificial sequence
  Synthetic oligonucleotide
atagcacacgcttctgtgtg

SEQ ID NO: 2772 - DNA, 20 bp, Artificial sequence
  Synthetic oligonucleotide
taatcatagcacacgcttct

SEQ ID NO: 2773 - DNA, 20 bp, Artificial sequence
  Synthetic oligonucleotide
aataataatcatagcacacg

SEQ ID NO: 2774 - DNA, 20 bp, Artificial sequence
  Synthetic oligonucleotide
ccaagtaataataatcatag

SEQ ID NO: 2775 - DNA, 20 bp, Artificial sequence
  Synthetic oligonucleotide
ctagtaatccaagtaataat

SEQ ID NO: 2776 - DNA, 20 bp, Artificial sequence
  Synthetic oligonucleotide
tatttctagtaatccaagta

SEQ ID NO: 2777 - DNA, 20 bp, Artificial sequence
  Synthetic oligonucleotide
cacactatttctagtaatcc

SEQ ID NO: 2778 - DNA, 20 bp, Artificial sequence
  Synthetic oligonucleotide
ttatgaggcacactatttct

SEQ ID NO: 2779 - DNA, 20 bp, Artificial sequence
  Synthetic oligonucleotide
tttaattatgaggcacacta

SEQ ID NO: 2780 - DNA, 20 bp, Artificial sequence
  Synthetic oligonucleotide
gttgacctttaattatgagg

SEQ ID NO: 2781 - DNA, 20 bp, Artificial sequence
  Synthetic oligonucleotide
ttacattgttgaatgttgac

SEQ ID NO: 2782 - DNA, 20 bp, Artificial sequence
  Synthetic oligonucleotide
attaattacattgttgaatg

SEQ ID NO: 2783 - DNA, 20 bp, Artificial sequence
  Synthetic oligonucleotide
tgtagattaattacattgtt

SEQ ID NO: 2784 - DNA, 20 bp, Artificial sequence
  Synthetic oligonucleotide
tacattgtagattaattaca

SEQ ID NO: 2785 - DNA, 20 bp, Artificial sequence
  Synthetic oligonucleotide
agatgtttacattgtagatt

SEQ ID NO: 2786 - DNA, 20 bp, Artificial sequence
  Synthetic oligonucleotide
ttcaccagatgtttacattg

SEQ ID NO: 2787 - DNA, 20 bp, Artificial sequence
  Synthetic oligonucleotide
gtcacttcaccagatgttta

SEQ ID NO: 2788 - DNA, 20 bp, Artificial sequence
  Synthetic oligonucleotide
cctctgtcacttcaccagat

SEQ ID NO: 2789 - DNA, 20 bp, Artificial sequence
  Synthetic oligonucleotide
gcttccctctgtcacttcac

SEQ ID NO: 2790 - DNA, 20 bp, Artificial sequence
  Synthetic oligonucleotide
caagtgcttccctctgtcac

SEQ ID NO: 2791 - DNA, 20 bp, Artificial sequence
  Synthetic oligonucleotide
gcttttttctaaacaagtgc

SEQ ID NO: 2792 - DNA, 20 bp, Artificial sequence
  Synthetic oligonucleotide
acatagcttttttctaaaca

SEQ ID NO: 2793 - DNA, 20 bp, Artificial sequence
  Synthetic oligonucleotide
ttctgacatagcttttttct

SEQ ID NO: 2794 - DNA, 20 bp, Artificial sequence
  Synthetic oligonucleotide
atggattctgacatagcttt

SEQ ID NO: 2795 - DNA, 20 bp, Artificial sequence
  Synthetic oligonucleotide
aatacatggattctgacata

SEQ ID NO: 2796 - DNA, 20 bp, Artificial sequence
  Synthetic oligonucleotide
attagaatacatggattctg

SEQ ID NO: 2797 - DNA, 20 bp, Artificial sequence
  Synthetic oligonucleotide
ttgtactgcatattagaata

SEQ ID NO: 2798 - DNA, 20 bp, Artificial sequence
  Synthetic oligonucleotide
aactattgtactgcatatta

SEQ ID NO: 2799 - DNA, 20 bp, Artificial sequence
  Synthetic oligonucleotide
ttttaaactattgtactgca

SEQ ID NO: 2800 - DNA, 20 bp, Artificial sequence
  Synthetic oligonucleotide
tgagagtattattaatattt

SEQ ID NO: 2801 - DNA, 20 bp, Artificial sequence
  Synthetic oligonucleotide
gctgtttgagagtattatta

SEQ ID NO: 2802 - DNA, 20 bp, Artificial sequence
  Synthetic oligonucleotide
gaatagctgtttgagagtat

SEQ ID NO: 2803 - DNA, 20 bp, Artificial sequence
  Synthetic oligonucleotide
cctcttgaatagctgtttga

SEQ ID NO: 2804 - DNA, 20 bp, Artificial sequence
  Synthetic oligonucleotide
tgaatcctcttgaatagctg

SEQ ID NO: 2805 - DNA, 20 bp, Artificial sequence
  Synthetic oligonucleotide
ttttttgaatcctcttgaat

SEQ ID NO: 2806 - DNA, 20 bp, Artificial sequence
  Synthetic oligonucleotide
ttatgttttttgaatcctct

SEQ ID NO: 2807 - DNA, 20 bp, Artificial sequence
  Synthetic oligonucleotide
gtttatattatgttttttga

SEQ ID NO: 2808 - DNA, 20 bp, Artificial sequence
  Synthetic oligonucleotide
tctgagtttatattatgttt

SEQ ID NO: 2809 - DNA, 20 bp, Artificial sequence
  Synthetic oligonucleotide
cagtttctctgagtttatat

SEQ ID NO: 2810 - DNA, 20 bp, Artificial sequence
  Synthetic oligonucleotide
gtttaccagtttctctgagt

SEQ ID NO: 2811 - DNA, 20 bp, Artificial sequence
  Synthetic oligonucleotide
attttgtttaccagtttctc

SEQ ID NO: 2812 - DNA, 20 bp, Artificial sequence
  Synthetic oligonucleotide
aaatgattttgtttaccagt

SEQ ID NO: 2813 - DNA, 20 bp, Artificial sequence
  Synthetic oligonucleotide
ctcttgaaaatgattttgtt

SEQ ID NO: 2814 - DNA, 20 bp, Artificial sequence
  Synthetic oligonucleotide
tatatctcttgaaaatgatt

SEQ ID NO: 2815 - DNA, 20 bp, Artificial sequence
  Synthetic oligonucleotide
caggttggcaagtttgtttg

SEQ ID NO: 2816 - DNA, 20 bp, Artificial sequence
  Synthetic oligonucleotide
gttggcaggttggcaagttt

SEQ ID NO: 2817 - DNA, 20 bp, Artificial sequence
  Synthetic oligonucleotide
atatctgtagatgttggcag

SEQ ID NO: 2818 - DNA, 20 bp, Artificial sequence
  Synthetic oligonucleotide
taaacatatctgtagatgtt

SEQ ID NO: 2819 - DNA, 20 bp, Artificial sequence
  Synthetic oligonucleotide
acctgtaaacatatctgtag

SEQ ID NO: 2820 - DNA, 20 bp, Artificial sequence
  Synthetic oligonucleotide
ttttgacctgtaaacatatc

SEQ ID NO: 2821 - DNA, 20 bp, Artificial sequence
  Synthetic oligonucleotide
ataatttttgacctgtaaac

SEQ ID NO: 2822 - DNA, 20 bp, Artificial sequence
  Synthetic oligonucleotide
taatttgataatttttgacc

SEQ ID NO: 2823 - DNA, 20 bp, Artificial sequence
  Synthetic oligonucleotide
ttcttgataatttgataatt

SEQ ID NO: 2824 - DNA, 20 bp, Artificial sequence
  Synthetic oligonucleotide
accaggctttcttgataatt

SEQ ID NO: 2825 - DNA, 20 bp, Artificial sequence
  Synthetic oligonucleotide
tttgaaccaggctttcttga

SEQ ID NO: 2826 - DNA, 20 bp, Artificial sequence
  Synthetic oligonucleotide
agacataatacataatttga

SEQ ID NO: 2827 - DNA, 20 bp, Artificial sequence
  Synthetic oligonucleotide
ctgtgataaagacataatac

SEQ ID NO: 2828 - DNA, 20 bp, Artificial sequence
  Synthetic oligonucleotide
cagacctgtgataaagacat

SEQ ID NO: 2829 - DNA, 20 bp, Artificial sequence
  Synthetic oligonucleotide
atcttcagacctgtgataaa

SEQ ID NO: 2830 - DNA, 20 bp, Artificial sequence
  Synthetic oligonucleotide
tactgatcttcagacctgtg

SEQ ID NO: 2831 - DNA, 20 bp, Artificial sequence
  Synthetic oligonucleotide
ttaataattttcagttttag

SEQ ID NO: 2832 - DNA, 20 bp, Artificial sequence
  Synthetic oligonucleotide
taagtttaataattttcagt

SEQ ID NO: 2833 - DNA, 20 bp, Artificial sequence
  Synthetic oligonucleotide
ttcagattttaagtttaata

SEQ ID NO: 2834 - DNA, 20 bp, Artificial sequence
  Synthetic oligonucleotide
tatatttgatattctgttca

SEQ ID NO: 2835 - DNA, 20 bp, Artificial sequence
  Synthetic oligonucleotide
atattgtaatgtattctttt

SEQ ID NO: 2836 - DNA, 20 bp, Artificial sequence
  Synthetic oligonucleotide
ttagaatattgtaatgtatt

SEQ ID NO: 2837 - DNA, 20 bp, Artificial sequence
  Synthetic oligonucleotide
tttgcttagaatattgtaat

SEQ ID NO: 2838 - DNA, 20 bp, Artificial sequence
  Synthetic oligonucleotide
actgctttgcttagaatatt

SEQ ID NO: 2839 - DNA, 20 bp, Artificial sequence
  Synthetic oligonucleotide
aagtagagactgctttgctt

SEQ ID NO: 2840 - DNA, 20 bp, Artificial sequence
  Synthetic oligonucleotide
gcaaggccaaaagtagagac

SEQ ID NO: 2841 - DNA, 20 bp, Artificial sequence
  Synthetic oligonucleotide
acagagcaaggccaaaagta

SEQ ID NO: 2842 - DNA, 20 bp, Artificial sequence
  Synthetic oligonucleotide
ggaaaacagagcaaggccaa

SEQ ID NO: 2843 - DNA, 20 bp, Artificial sequence
  Synthetic oligonucleotide
tggtcggaaaacagagcaag

SEQ ID NO: 2844 - DNA, 20 bp, Artificial sequence
  Synthetic oligonucleotide
gacattggtcggaaaacaga

SEQ ID NO: 2845 - DNA, 20 bp, Artificial sequence
  Synthetic oligonucleotide
aagcagacattggtcggaaa

SEQ ID NO: 2846 - DNA, 20 bp, Artificial sequence
  Synthetic oligonucleotide
caaggcaaaaaagcagacat

SEQ ID NO: 2847 - DNA, 20 bp, Artificial sequence
  Synthetic oligonucleotide
ataaagcaaggcaaaaaagc

SEQ ID NO: 2848 - DNA, 20 bp, Artificial sequence
  Synthetic oligonucleotide
cattatttaataagataaaa

SEQ ID NO: 2849 - DNA, 20 bp, Artificial sequence
  Synthetic oligonucleotide
aaatatttaatcagggacat

SEQ ID NO: 2850 - DNA, 20 bp, Artificial sequence
  Synthetic oligonucleotide
tgttctcaaaatatttaatc

SEQ ID NO: 2851 - DNA, 20 bp, Artificial sequence
  Synthetic oligonucleotide
gattacctgttctcaaaata

SEQ ID NO: 2852 - DNA, 20 bp, Artificial sequence
  Synthetic oligonucleotide
gattgtacagattacctgtt

SEQ ID NO: 2853 - DNA, 20 bp, Artificial sequence
  Synthetic oligonucleotide
attcagattgtacagattac

SEQ ID NO: 2854 - DNA, 20 bp, Artificial sequence
  Synthetic oligonucleotide
aaacagtgttattcagattg

SEQ ID NO: 2855 - DNA, 20 bp, Artificial sequence
  Synthetic oligonucleotide
tagataaacagtgttattca

SEQ ID NO: 2856 - DNA, 20 bp, Artificial sequence
  Synthetic oligonucleotide
atatttagataaacagtgtt

SEQ ID NO: 2857 - DNA, 20 bp, Artificial sequence
  Synthetic oligonucleotide
gtttgatatttagataaaca

SEQ ID NO: 2858 - DNA, 20 bp, Artificial sequence
  Synthetic oligonucleotide
aacggtgtttgatatttaga

SEQ ID NO: 2859 - DNA, 20 bp, Artificial sequence
  Synthetic oligonucleotide
gttataacggtgtttgatat

SEQ ID NO: 2860 - DNA, 20 bp, Artificial sequence
  Synthetic oligonucleotide
ataatgttataacggtgttt

SEQ ID NO: 2861 - DNA, 20 bp, Artificial sequence
  Synthetic oligonucleotide
agttcataatgttataacgg

SEQ ID NO: 2862 - DNA, 20 bp, Artificial sequence
  Synthetic oligonucleotide
ctttcagttcataatgttat

SEQ ID NO: 2863 - DNA, 20 bp, Artificial sequence
  Synthetic oligonucleotide
agtacagtttgtctttcagt

SEQ ID NO: 2864 - DNA, 20 bp, Artificial sequence
  Synthetic oligonucleotide
tcagaagtacagtttgtctt

SEQ ID NO: 2865 - DNA, 20 bp, Artificial sequence
  Synthetic oligonucleotide
ggatgtcagaagtacagttt

SEQ ID NO: 2866 - DNA, 20 bp, Artificial sequence
  Synthetic oligonucleotide
gagtaaggatgtcagaagta

SEQ ID NO: 2867 - DNA, 20 bp, Artificial sequence
  Synthetic oligonucleotide
gaaatctgagtaaggatgtc

SEQ ID NO: 2868 - DNA, 20 bp, Artificial sequence
  Synthetic oligonucleotide
tactgaatatacaattaggg

SEQ ID NO: 2869 - DNA, 20 bp, Artificial sequence
  Synthetic oligonucleotide
aatgatactgaatatacaat

SEQ ID NO: 2870 - DNA, 20 bp, Artificial sequence
  Synthetic oligonucleotide
gaatataaatctgtttttta

SEQ ID NO: 2871 - DNA, 20 bp, Artificial sequence
  Synthetic oligonucleotide
taaaagaatataaatctgtt

SEQ ID NO: 2872 - DNA, 20 bp, Artificial sequence
  Synthetic oligonucleotide
gctgataaaagaatataaat

SEQ ID NO: 2873 - DNA, 20 bp, Artificial sequence
  Synthetic oligonucleotide
ccttctgagctgataaaaga

SEQ ID NO: 2874 - DNA, 20 bp, Artificial sequence
  Synthetic oligonucleotide
ctagtccttctgagctgata

SEQ ID NO: 2875 - DNA, 20 bp, Artificial sequence
  Synthetic oligonucleotide
ttaccatcatgttttacatt

SEQ ID NO: 2876 - DNA, 20 bp, Artificial sequence
  Synthetic oligonucleotide
caaagtgtcttaccatcatg

SEQ ID NO: 2877 - DNA, 20 bp, Artificial sequence
  Synthetic oligonucleotide
aaacccaccaaagtgtctta

SEQ ID NO: 2878 - DNA, 20 bp, Artificial sequence
  Synthetic oligonucleotide
agaaggaaacccaccaaagt

SEQ ID NO: 2879 - DNA, 20 bp, Artificial sequence
  Synthetic oligonucleotide
aataatagcttcaagaagga

SEQ ID NO: 2880 - DNA, 20 bp, Artificial sequence
  Synthetic oligonucleotide
aatttgataataatagcttc

SEQ ID NO: 2881 - DNA, 20 bp, Artificial sequence
  Synthetic oligonucleotide
tagggaatttgataataata

SEQ ID NO: 2882 - DNA, 20 bp, Artificial sequence
  Synthetic oligonucleotide
aagaatagggaatttgataa

SEQ ID NO: 2883 - DNA, 20 bp, Artificial sequence
  Synthetic oligonucleotide
gtcctaagaatagggaattt

SEQ ID NO: 2884 - DNA, 20 bp, Artificial sequence
  Synthetic oligonucleotide
tagaacaagtcctaagaata

SEQ ID NO: 2885 - DNA, 20 bp, Artificial sequence
  Synthetic oligonucleotide
ttagtctagaacaagtccta

SEQ ID NO: 2886 - DNA, 20 bp, Artificial sequence
  Synthetic oligonucleotide
atcttttagtctagaacaag

SEQ ID NO: 2887 - DNA, 20 bp, Artificial sequence
  Synthetic oligonucleotide
taactatcttttagtctaga

SEQ ID NO: 2888 - DNA, 20 bp, Artificial sequence
  Synthetic oligonucleotide
atctcttaactatcttttag

SEQ ID NO: 2889 - DNA, 20 bp, Artificial sequence
  Synthetic oligonucleotide
tggatatctcttaactatct

SEQ ID NO: 2890 - DNA, 20 bp, Artificial sequence
  Synthetic oligonucleotide
tttgatggatatctcttaac

SEQ ID NO: 2891 - DNA, 20 bp, Artificial sequence
  Synthetic oligonucleotide
ttaattctgcttcattaggt

SEQ ID NO: 2892 - DNA, 20 bp, Artificial sequence
  Synthetic oligonucleotide
tttaattctgcttcattagg

SEQ ID NO: 2893 - DNA, 20 bp, Artificial sequence
  Synthetic oligonucleotide
cagtatttaattctgcttca

SEQ ID NO: 2894 - DNA, 20 bp, Artificial sequence
  Synthetic oligonucleotide
acagtatttaattctgcttc

SEQ ID NO: 2895 - DNA, 20 bp, Artificial sequence
  Synthetic oligonucleotide
tacagtatttaattctgctt

SEQ ID NO: 2896 - DNA, 20 bp, Artificial sequence
  Synthetic oligonucleotide
atacagtatttaattctgct

SEQ ID NO: 2897 - DNA, 20 bp, Artificial sequence
  Synthetic oligonucleotide
aatacagtatttaattctgc

SEQ ID NO: 2898 - DNA, 20 bp, Artificial sequence
  Synthetic oligonucleotide
taatacagtatttaattctg

SEQ ID NO: 2899 - DNA, 20 bp, Artificial sequence
  Synthetic oligonucleotide
tttaatacagtatttaattc

SEQ ID NO: 2900 - DNA, 20 bp, Artificial sequence
  Synthetic oligonucleotide
ttttaatacagtatttaatt

SEQ ID NO: 2901 - DNA, 20 bp, Artificial sequence
  Synthetic oligonucleotide
ttattttaatacagtattta

SEQ ID NO: 2902 - DNA, 20 bp, Artificial sequence
  Synthetic oligonucleotide
aacttattttaatacagtat

SEQ ID NO: 2903 - DNA, 20 bp, Artificial sequence
  Synthetic oligonucleotide
gaacttattttaatacagta

SEQ ID NO: 2904 - DNA, 20 bp, Artificial sequence
  Synthetic oligonucleotide
cgaacttattttaatacagt

SEQ ID NO: 2905 - DNA, 20 bp, Artificial sequence
  Synthetic oligonucleotide
gcgaacttattttaatacag

SEQ ID NO: 2906 - DNA, 20 bp, Artificial sequence
  Synthetic oligonucleotide
agcgaacttattttaataca

SEQ ID NO: 2907 - DNA, 20 bp, Artificial sequence
  Synthetic oligonucleotide
cagcgaacttattttaatac

SEQ ID NO: 2908 - DNA, 20 bp, Artificial sequence
  Synthetic oligonucleotide
acagcgaacttattttaata

SEQ ID NO: 2909 - DNA, 20 bp, Artificial sequence
  Synthetic oligonucleotide
gacagcgaacttattttaat

SEQ ID NO: 2910 - DNA, 20 bp, Artificial sequence
  Synthetic oligonucleotide
agacagcgaacttattttaa

SEQ ID NO: 2911 - DNA, 20 bp, Artificial sequence
  Synthetic oligonucleotide
aaagacagcgaacttatttt

SEQ ID NO: 2912 - DNA, 20 bp, Artificial sequence
  Synthetic oligonucleotide
taaagacagcgaacttattt

SEQ ID NO: 2913 - DNA, 20 bp, Artificial sequence
  Synthetic oligonucleotide
gtttaaagacagcgaactta

SEQ ID NO: 2914 - DNA, 20 bp, Artificial sequence
  Synthetic oligonucleotide
tgtttaaagacagcgaactt

SEQ ID NO: 2915 - DNA, 20 bp, Artificial sequence
  Synthetic oligonucleotide
ttgtttaaagacagcgaact

SEQ ID NO: 2916 - DNA, 20 bp, Artificial sequence
  Synthetic oligonucleotide
tttgtttaaagacagcgaac

SEQ ID NO: 2917 - DNA, 20 bp, Artificial sequence
  Synthetic oligonucleotide
atttgtttaaagacagcgaa

SEQ ID NO: 2918 - DNA, 20 bp, Artificial sequence
  Synthetic oligonucleotide
catttgtttaaagacagcga

SEQ ID NO: 2919 - DNA, 20 bp, Artificial sequence
  Synthetic oligonucleotide
tccatttgtttaaagacagc

SEQ ID NO: 2920 - DNA, 20 bp, Artificial sequence
  Synthetic oligonucleotide
ctccatttgtttaaagacag

SEQ ID NO: 2921 - DNA, 20 bp, Artificial sequence
  Synthetic oligonucleotide
atctccatttgtttaaagac

SEQ ID NO: 2922 - DNA, 20 bp, Artificial sequence
  Synthetic oligonucleotide
catctccatttgtttaaaga

SEQ ID NO: 2923 - DNA, 20 bp, Artificial sequence
  Synthetic oligonucleotide
tcatctccatttgtttaaag

SEQ ID NO: 2924 - DNA, 20 bp, Artificial sequence
  Synthetic oligonucleotide
gtcatctccatttgtttaaa

SEQ ID NO: 2925 - DNA, 20 bp, Artificial sequence
  Synthetic oligonucleotide
tagtcatctccatttgttta

SEQ ID NO: 2926 - DNA, 20 bp, Artificial sequence
  Synthetic oligonucleotide
gtagtcatctccatttgttt

SEQ ID NO: 2927 - DNA, 20 bp, Artificial sequence
  Synthetic oligonucleotide
agtagtcatctccatttgtt

SEQ ID NO: 2928 - DNA, 20 bp, Artificial sequence
  Synthetic oligonucleotide
tagtagtcatctccatttgt

SEQ ID NO: 2929 - DNA, 20 bp, Artificial sequence
  Synthetic oligonucleotide
ttagtagtcatctccatttg

SEQ ID NO: 2930 - DNA, 20 bp, Artificial sequence
  Synthetic oligonucleotide
cttagtagtcatctccattt

SEQ ID NO: 2931 - DNA, 20 bp, Artificial sequence
  Synthetic oligonucleotide
gtgacttagtagtcatctcc

SEQ ID NO: 2932 - DNA, 20 bp, Artificial sequence
  Synthetic oligonucleotide
tgtgacttagtagtcatctc

SEQ ID NO: 2933 - DNA, 20 bp, Artificial sequence
  Synthetic oligonucleotide
atgtgacttagtagtcatct

SEQ ID NO: 2934 - DNA, 20 bp, Artificial sequence
  Synthetic oligonucleotide
aatgtgacttagtagtcatc

SEQ ID NO: 2935 - DNA, 20 bp, Artificial sequence
  Synthetic oligonucleotide
caatgtgacttagtagtcat

SEQ ID NO: 2936 - DNA, 20 bp, Artificial sequence
  Synthetic oligonucleotide
tcaatgtgacttagtagtca

SEQ ID NO: 2937 - DNA, 20 bp, Artificial sequence
  Synthetic oligonucleotide
agtcaatgtgacttagtagt

SEQ ID NO: 2938 - DNA, 20 bp, Artificial sequence
  Synthetic oligonucleotide
ttaaagtcaatgtgacttag

SEQ ID NO: 2939 - DNA, 20 bp, Artificial sequence
  Synthetic oligonucleotide
gttaaagtcaatgtgactta

SEQ ID NO: 2940 - DNA, 20 bp, Artificial sequence
  Synthetic oligonucleotide
tgttaaagtcaatgtgactt

SEQ ID NO: 2941 - DNA, 20 bp, Artificial sequence
  Synthetic oligonucleotide
atgttaaagtcaatgtgact

SEQ ID NO: 2942 - DNA, 20 bp, Artificial sequence
  Synthetic oligonucleotide
catgttaaagtcaatgtgac

SEQ ID NO: 2943 - DNA, 20 bp, Artificial sequence
  Synthetic oligonucleotide
ctcatgttaaagtcaatgtg

SEQ ID NO: 2944 - DNA, 20 bp, Artificial sequence
  Synthetic oligonucleotide
cctcatgttaaagtcaatgt

SEQ ID NO: 2945 - DNA, 20 bp, Artificial sequence
  Synthetic oligonucleotide
acctcatgttaaagtcaatg

SEQ ID NO: 2946 - DNA, 20 bp, Artificial sequence
  Synthetic oligonucleotide
tacctcatgttaaagtcaat

SEQ ID NO: 2947 - DNA, 20 bp, Artificial sequence
  Synthetic oligonucleotide
atacctcatgttaaagtcaa

SEQ ID NO: 2948 - DNA, 20 bp, Artificial sequence
  Synthetic oligonucleotide
gatacctcatgttaaagtca

SEQ ID NO: 2949 - DNA, 20 bp, Artificial sequence
  Synthetic oligonucleotide
tgatacctcatgttaaagtc

SEQ ID NO: 2950 - DNA, 20 bp, Artificial sequence
  Synthetic oligonucleotide
gtgatacctcatgttaaagt

SEQ ID NO: 2951 - DNA, 20 bp, Artificial sequence
  Synthetic oligonucleotide
agtgatacctcatgttaaag

SEQ ID NO: 2952 - DNA, 20 bp, Artificial sequence
  Synthetic oligonucleotide
tagtgatacctcatgttaaa

SEQ ID NO: 2953 - DNA, 20 bp, Artificial sequence
  Synthetic oligonucleotide
atagtgatacctcatgttaa

SEQ ID NO: 2954 - DNA, 20 bp, Artificial sequence
  Synthetic oligonucleotide
tatagtgatacctcatgtta

SEQ ID NO: 2955 - DNA, 20 bp, Artificial sequence
  Synthetic oligonucleotide
gtatagtgatacctcatgtt

SEQ ID NO: 2956 - DNA, 20 bp, Artificial sequence
  Synthetic oligonucleotide
ggtatagtgatacctcatgt

SEQ ID NO: 2957 - DNA, 20 bp, Artificial sequence
  Synthetic oligonucleotide
ataaggtatagtgatacctc

SEQ ID NO: 2958 - DNA, 20 bp, Artificial sequence
  Synthetic oligonucleotide
aataaggtatagtgatacct

SEQ ID NO: 2959 - DNA, 20 bp, Artificial sequence
  Synthetic oligonucleotide
taatgtttaaattattgcct

SEQ ID NO: 2960 - DNA, 20 bp, Artificial sequence
  Synthetic oligonucleotide
ggttaatgtttaaattattg

SEQ ID NO: 2961 - DNA, 20 bp, Artificial sequence
  Synthetic oligonucleotide
aggttaatgtttaaattatt

SEQ ID NO: 2962 - DNA, 20 bp, Artificial sequence
  Synthetic oligonucleotide
gaggttaatgtttaaattat

SEQ ID NO: 2963 - DNA, 20 bp, Artificial sequence
  Synthetic oligonucleotide
tgaggttaatgtttaaatta

SEQ ID NO: 2964 - DNA, 20 bp, Artificial sequence
  Synthetic oligonucleotide
aatgaggttaatgtttaaat

SEQ ID NO: 2965 - DNA, 20 bp, Artificial sequence
  Synthetic oligonucleotide
gaatgaggttaatgtttaaa

SEQ ID NO: 2966 - DNA, 20 bp, Artificial sequence
  Synthetic oligonucleotide
ggaatgaggttaatgtttaa

SEQ ID NO: 2967 - DNA, 20 bp, Artificial sequence
  Synthetic oligonucleotide
tggaatgaggttaatgttta

SEQ ID NO: 2968 - DNA, 20 bp, Artificial sequence
  Synthetic oligonucleotide
ttggaatgaggttaatgttt

SEQ ID NO: 2969 - DNA, 20 bp, Artificial sequence
  Synthetic oligonucleotide
cttggaatgaggttaatgtt

SEQ ID NO: 2970 - DNA, 20 bp, Artificial sequence
  Synthetic oligonucleotide
taacttggaatgaggttaat

SEQ ID NO: 2971 - DNA, 20 bp, Artificial sequence
  Synthetic oligonucleotide
ttaacttggaatgaggttaa

SEQ ID NO: 2972 - DNA, 20 bp, Artificial sequence
  Synthetic oligonucleotide
attaacttggaatgaggtta

SEQ ID NO: 2973 - DNA, 20 bp, Artificial sequence
  Synthetic oligonucleotide
cattaacttggaatgaggtt

SEQ ID NO: 2974 - DNA, 20 bp, Artificial sequence
  Synthetic oligonucleotide
acattaacttggaatgaggt

SEQ ID NO: 2975 - DNA, 20 bp, Artificial sequence
  Synthetic oligonucleotide
accacattaacttggaatga

SEQ ID NO: 2976 - DNA, 20 bp, Artificial sequence
  Synthetic oligonucleotide
gaccacattaacttggaatg

SEQ ID NO: 2977 - DNA, 20 bp, Artificial sequence
  Synthetic oligonucleotide
agaccacattaacttggaat

SEQ ID NO: 2978 - DNA, 20 bp, Artificial sequence
  Synthetic oligonucleotide
tagaccacattaacttggaa

SEQ ID NO: 2979 - DNA, 20 bp, Artificial sequence
  Synthetic oligonucleotide
ttagaccacattaacttgga

SEQ ID NO: 2980 - DNA, 20 bp, Artificial sequence
  Synthetic oligonucleotide
attagaccacattaacttgg

SEQ ID NO: 2981 - DNA, 20 bp, Artificial sequence
  Synthetic oligonucleotide
tattagaccacattaacttg

SEQ ID NO: 2982 - DNA, 20 bp, Artificial sequence
  Synthetic oligonucleotide
ttattagaccacattaactt

SEQ ID NO: 2983 - DNA, 20 bp, Artificial sequence
  Synthetic oligonucleotide
attattagaccacattaact

SEQ ID NO: 2984 - DNA, 20 bp, Artificial sequence
  Synthetic oligonucleotide
gattattagaccacattaac

SEQ ID NO: 2985 - DNA, 20 bp, Artificial sequence
  Synthetic oligonucleotide
aataccagattattagacca

SEQ ID NO: 2986 - DNA, 20 bp, Artificial sequence
  Synthetic oligonucleotide
taataccagattattagacc

SEQ ID NO: 2987 - DNA, 20 bp, Artificial sequence
  Synthetic oligonucleotide
tttaataccagattattaga

SEQ ID NO: 2988 - DNA, 20 bp, Artificial sequence
  Synthetic oligonucleotide
atttaataccagattattag

SEQ ID NO: 2989 - DNA, 20 bp, Artificial sequence
  Synthetic oligonucleotide
gatttaataccagattatta

SEQ ID NO: 2990 - DNA, 20 bp, Artificial sequence
  Synthetic oligonucleotide
taaggatttaataccagatt

SEQ ID NO: 2991 - DNA, 20 bp, Artificial sequence
  Synthetic oligonucleotide
tttctcttaaggatttaata

SEQ ID NO: 2992 - DNA, 20 bp, Artificial sequence
  Synthetic oligonucleotide
ctttctcttaaggatttaat

SEQ ID NO: 2993 - DNA, 20 bp, Artificial sequence
  Synthetic oligonucleotide
agctttctcttaaggattta

SEQ ID NO: 2994 - DNA, 20 bp, Artificial sequence
  Synthetic oligonucleotide
aagctttctcttaaggattt

SEQ ID NO: 2995 - DNA, 20 bp, Artificial sequence
  Synthetic oligonucleotide
tcaagctttctcttaaggat

SEQ ID NO: 2996 - DNA, 20 bp, Artificial sequence
  Synthetic oligonucleotide
ttctcaagctttctcttaag

SEQ ID NO: 2997 - DNA, 20 bp, Artificial sequence
  Synthetic oligonucleotide
tttctcaagctttctcttaa

SEQ ID NO: 2998 - DNA, 20 bp, Artificial sequence
  Synthetic oligonucleotide
tctatttctcaagctttctc

SEQ ID NO: 2999 - DNA, 20 bp, Artificial sequence
  Synthetic oligonucleotide
atctatttctcaagctttct

SEQ ID NO: 3000 - DNA, 20 bp, Artificial sequence
  Synthetic oligonucleotide
aatctatttctcaagctttc

SEQ ID NO: 3001 - DNA, 20 bp, Artificial sequence
  Synthetic oligonucleotide
aaatctatttctcaagcttt

SEQ ID NO: 3002 - DNA, 20 bp, Artificial sequence
  Synthetic oligonucleotide
aaaatctatttctcaagctt

SEQ ID NO: 3003 - DNA, 20 bp, Artificial sequence
  Synthetic oligonucleotide
gataaaaaaaatctatttct

SEQ ID NO: 3004 - DNA, 20 bp, Artificial sequence
  Synthetic oligonucleotide
tagacagtgactttaagata

SEQ ID NO: 3005 - DNA, 20 bp, Artificial sequence
  Synthetic oligonucleotide
atagacagtgactttaagat

SEQ ID NO: 3006 - DNA, 20 bp, Artificial sequence
  Synthetic oligonucleotide
aatagacagtgactttaaga

SEQ ID NO: 3007 - DNA, 20 bp, Artificial sequence
  Synthetic oligonucleotide
aaatagacagtgactttaag

SEQ ID NO: 3008 - DNA, 20 bp, Artificial sequence
  Synthetic oligonucleotide
taaatagacagtgactttaa

SEQ ID NO: 3009 - DNA, 20 bp, Artificial sequence
  Synthetic oligonucleotide
ttaaatagacagtgacttta

SEQ ID NO: 3010 - DNA, 20 bp, Artificial sequence
  Synthetic oligonucleotide
cttaaatagacagtgacttt

SEQ ID NO: 3011 - DNA, 20 bp, Artificial sequence
  Synthetic oligonucleotide
tcttaaatagacagtgactt

SEQ ID NO: 3012 - DNA, 20 bp, Artificial sequence
  Synthetic oligonucleotide
atcttaaatagacagtgact

SEQ ID NO: 3013 - DNA, 20 bp, Artificial sequence
  Synthetic oligonucleotide
aatcttaaatagacagtgac

SEQ ID NO: 3014 - DNA, 20 bp, Artificial sequence
  Synthetic oligonucleotide
taatcttaaatagacagtga

SEQ ID NO: 3015 - DNA, 20 bp, Artificial sequence
  Synthetic oligonucleotide
ttaatcttaaatagacagtg

SEQ ID NO: 3016 - DNA, 20 bp, Artificial sequence
  Synthetic oligonucleotide
tttaatcttaaatagacagt

SEQ ID NO: 3017 - DNA, 20 bp, Artificial sequence
  Synthetic oligonucleotide
gtttaatcttaaatagacag

SEQ ID NO: 3018 - DNA, 20 bp, Artificial sequence
  Synthetic oligonucleotide
tgtttaatcttaaatagaca

SEQ ID NO: 3019 - DNA, 20 bp, Artificial sequence
  Synthetic oligonucleotide
atgtttaatcttaaatagac

SEQ ID NO: 3020 - DNA, 20 bp, Artificial sequence
  Synthetic oligonucleotide
ttgtatgtttaatcttaaat

SEQ ID NO: 3021 - DNA, 20 bp, Artificial sequence
  Synthetic oligonucleotide
attgtatgtttaatcttaaa

SEQ ID NO: 3022 - DNA, 20 bp, Artificial sequence
  Synthetic oligonucleotide
gattgtatgtttaatcttaa

SEQ ID NO: 3023 - DNA, 20 bp, Artificial sequence
  Synthetic oligonucleotide
tgattgtatgtttaatctta

SEQ ID NO: 3024 - DNA, 20 bp, Artificial sequence
  Synthetic oligonucleotide
tatgtgattgtatgtttaat

SEQ ID NO: 3025 - DNA, 20 bp, Artificial sequence
  Synthetic oligonucleotide
gttatgtgattgtatgttta

SEQ ID NO: 3026 - DNA, 20 bp, Artificial sequence
  Synthetic oligonucleotide
taaggttatgtgattgtatg

SEQ ID NO: 3027 - DNA, 20 bp, Artificial sequence
  Synthetic oligonucleotide
ttaaggttatgtgattgtat

SEQ ID NO: 3028 - DNA, 20 bp, Artificial sequence
  Synthetic oligonucleotide
ttctttaaggttatgtgatt

SEQ ID NO: 3029 - DNA, 16 bp, Artificial sequence
  Synthetic oligonucleotide
tctggaagcagaccta

SEQ ID NO: 3030 - DNA, 16 bp, Artificial sequence
  Synthetic oligonucleotide
cttctggaagcagacc

SEQ ID NO: 3031 - DNA, 16 bp, Artificial sequence
  Synthetic oligonucleotide
aaataaggtatagtga

SEQ ID NO: 3032 - DNA, 16 bp, Artificial sequence
  Synthetic oligonucleotide
tagtattaagtgttaa

SEQ ID NO: 3033 - DNA, 16 bp, Artificial sequence
  Synthetic oligonucleotide
tcatagtattaagtgt

SEQ ID NO: 3034 - DNA, 16 bp, Artificial sequence
  Synthetic oligonucleotide
agattcctttacaatt

SEQ ID NO: 3035 - DNA, 16 bp, Artificial sequence
  Synthetic oligonucleotide
acaagattcctttaca

SEQ ID NO: 3036 - DNA, 16 bp, Artificial sequence
  Synthetic oligonucleotide
ctgacaagattccttt

SEQ ID NO: 3037 - DNA, 16 bp, Artificial sequence
  Synthetic oligonucleotide
tgtaatctgacaagat

SEQ ID NO: 3038 - DNA, 16 bp, Artificial sequence
  Synthetic oligonucleotide
tactgtaatctgacaa

SEQ ID NO: 3039 - DNA, 16 bp, Artificial sequence
  Synthetic oligonucleotide
tcttactgtaatctga

SEQ ID NO: 3040 - DNA, 16 bp, Artificial sequence
  Synthetic oligonucleotide
cattcttactgtaatc

SEQ ID NO: 3041 - DNA, 16 bp, Artificial sequence
  Synthetic oligonucleotide
gttcattcttactgta

SEQ ID NO: 3042 - DNA, 16 bp, Artificial sequence
  Synthetic oligonucleotide
atatgttcattcttac

SEQ ID NO: 3043 - DNA, 16 bp, Artificial sequence
  Synthetic oligonucleotide
gccacaaatatgttca

SEQ ID NO: 3044 - DNA, 16 bp, Artificial sequence
  Synthetic oligonucleotide
gatgccacaaatatgt

SEQ ID NO: 3045 - DNA, 16 bp, Artificial sequence
  Synthetic oligonucleotide
ctttaactcgatgcca

SEQ ID NO: 3046 - DNA, 16 bp, Artificial sequence
  Synthetic oligonucleotide
aaactttaactcgatg

SEQ ID NO: 3047 - DNA, 16 bp, Artificial sequence
  Synthetic oligonucleotide
tataaactttaactcg

SEQ ID NO: 3048 - DNA, 16 bp, Artificial sequence
  Synthetic oligonucleotide
cacagcatatttaggg

SEQ ID NO: 3049 - DNA, 16 bp, Artificial sequence
  Synthetic oligonucleotide
tagaatcacagcatat

SEQ ID NO: 3050 - DNA, 16 bp, Artificial sequence
  Synthetic oligonucleotide
tattagaatcacagca

SEQ ID NO: 3051 - DNA, 16 bp, Artificial sequence
  Synthetic oligonucleotide
aatgtattagaatcac

SEQ ID NO: 3052 - DNA, 16 bp, Artificial sequence
  Synthetic oligonucleotide
acgaatgtattagaat

SEQ ID NO: 3053 - DNA, 16 bp, Artificial sequence
  Synthetic oligonucleotide
tacacgaatgtattag

SEQ ID NO: 3054 - DNA, 16 bp, Artificial sequence
  Synthetic oligonucleotide
acctacacgaatgtat

SEQ ID NO: 3055 - DNA, 16 bp, Artificial sequence
  Synthetic oligonucleotide
aaaacctacacgaatg

SEQ ID NO: 3056 - DNA, 16 bp, Artificial sequence
  Synthetic oligonucleotide
ttgaaaacctacacga

SEQ ID NO: 3057 - DNA, 16 bp, Artificial sequence
  Synthetic oligonucleotide
tacttgaaaacctaca

SEQ ID NO: 3058 - DNA, 16 bp, Artificial sequence
  Synthetic oligonucleotide
gtttatttctacttga

SEQ ID NO: 3059 - DNA, 16 bp, Artificial sequence
  Synthetic oligonucleotide
gaggtttatttctact

SEQ ID NO: 3060 - DNA, 16 bp, Artificial sequence
  Synthetic oligonucleotide
tacgaggtttatttct

SEQ ID NO: 3061 - DNA, 16 bp, Artificial sequence
  Synthetic oligonucleotide
tgttacgaggtttatt

SEQ ID NO: 3062 - DNA, 16 bp, Artificial sequence
  Synthetic oligonucleotide
acttgttacgaggttt

SEQ ID NO: 3063 - DNA, 16 bp, Artificial sequence
  Synthetic oligonucleotide
cagtaacttgttacga

SEQ ID NO: 3064 - DNA, 16 bp, Artificial sequence
  Synthetic oligonucleotide
gttcagtaacttgtta

SEQ ID NO: 3065 - DNA, 16 bp, Artificial sequence
  Synthetic oligonucleotide
tcaggctgtttaaacg

SEQ ID NO: 3066 - DNA, 16 bp, Artificial sequence
  Synthetic oligonucleotide
ttgtcaggctgtttaa

SEQ ID NO: 3067 - DNA, 16 bp, Artificial sequence
  Synthetic oligonucleotide
tatacatgcttgtcag

SEQ ID NO: 3068 - DNA, 16 bp, Artificial sequence
  Synthetic oligonucleotide
gtctttgtttattgaa

SEQ ID NO: 3069 - DNA, 16 bp, Artificial sequence
  Synthetic oligonucleotide
tgggtctttgtttatt

SEQ ID NO: 3070 - DNA, 16 bp, Artificial sequence
  Synthetic oligonucleotide
gactgggtctttgttt

SEQ ID NO: 3071 - DNA, 16 bp, Artificial sequence
  Synthetic oligonucleotide
ataatttagggactgg

SEQ ID NO: 3072 - DNA, 16 bp, Artificial sequence
  Synthetic oligonucleotide
tctataatttagggac

SEQ ID NO: 3073 - DNA, 16 bp, Artificial sequence
  Synthetic oligonucleotide
cgataaacatgcaaga

SEQ ID NO: 3074 - DNA, 16 bp, Artificial sequence
  Synthetic oligonucleotide
tgtcgataaacatgca

SEQ ID NO: 3075 - DNA, 16 bp, Artificial sequence
  Synthetic oligonucleotide
tgatgtcgataaacat

SEQ ID NO: 3076 - DNA, 16 bp, Artificial sequence
  Synthetic oligonucleotide
ttgtgatgtcgataaa

SEQ ID NO: 3077 - DNA, 16 bp, Artificial sequence
  Synthetic oligonucleotide
ctgttgtgatgtcgat

SEQ ID NO: 3078 - DNA, 16 bp, Artificial sequence
  Synthetic oligonucleotide
gatctgttgtgatgtc

SEQ ID NO: 3079 - DNA, 16 bp, Artificial sequence
  Synthetic oligonucleotide
agggatctgttgtgat

SEQ ID NO: 3080 - DNA, 16 bp, Artificial sequence
  Synthetic oligonucleotide
tttagggatctgttgt

SEQ ID NO: 3081 - DNA, 16 bp, Artificial sequence
  Synthetic oligonucleotide
ggatttagggatctgt

SEQ ID NO: 3082 - DNA, 16 bp, Artificial sequence
  Synthetic oligonucleotide
gatttagggatttagg

SEQ ID NO: 3083 - DNA, 16 bp, Artificial sequence
  Synthetic oligonucleotide
tctttagggatttagg

SEQ ID NO: 3084 - DNA, 16 bp, Artificial sequence
  Synthetic oligonucleotide
taatctttagggattt

SEQ ID NO: 3085 - DNA, 16 bp, Artificial sequence
  Synthetic oligonucleotide
atctaatctttaggga

SEQ ID NO: 3086 - DNA, 16 bp, Artificial sequence
  Synthetic oligonucleotide
tgtatctaatctttag

SEQ ID NO: 3087 - DNA, 16 bp, Artificial sequence
  Synthetic oligonucleotide
aaatttgtatctaatc

SEQ ID NO: 3088 - DNA, 16 bp, Artificial sequence
  Synthetic oligonucleotide
gtaaaaaatttgtatc

SEQ ID NO: 3089 - DNA, 16 bp, Artificial sequence
  Synthetic oligonucleotide
gtggtaaaaaatttgt

SEQ ID NO: 3090 - DNA, 16 bp, Artificial sequence
  Synthetic oligonucleotide
gatactgtggtaaaaa

SEQ ID NO: 3091 - DNA, 16 bp, Artificial sequence
  Synthetic oligonucleotide
agtgatactgtggtaa

SEQ ID NO: 3092 - DNA, 16 bp, Artificial sequence
  Synthetic oligonucleotide
acaagtgatactgtgg

SEQ ID NO: 3093 - DNA, 16 bp, Artificial sequence
  Synthetic oligonucleotide
ctgacaagtgatactg

SEQ ID NO: 3094 - DNA, 16 bp, Artificial sequence
  Synthetic oligonucleotide
attctgacaagtgata

SEQ ID NO: 3095 - DNA, 16 bp, Artificial sequence
  Synthetic oligonucleotide
taaattctgacaagtg

SEQ ID NO: 3096 - DNA, 16 bp, Artificial sequence
  Synthetic oligonucleotide
tactggcagttttaaa

SEQ ID NO: 3097 - DNA, 16 bp, Artificial sequence
  Synthetic oligonucleotide
tcttactggcagtttt

SEQ ID NO: 3098 - DNA, 16 bp, Artificial sequence
  Synthetic oligonucleotide
atttcttactggcagt

SEQ ID NO: 3099 - DNA, 16 bp, Artificial sequence
  Synthetic oligonucleotide
aaaatttcttactggc

SEQ ID NO: 3100 - DNA, 16 bp, Artificial sequence
  Synthetic oligonucleotide
aacaaatgggtttaat

SEQ ID NO: 3101 - DNA, 16 bp, Artificial sequence
  Synthetic oligonucleotide
gaatatttgcaagtct

SEQ ID NO: 3102 - DNA, 16 bp, Artificial sequence
  Synthetic oligonucleotide
tcattggtagaggaat

SEQ ID NO: 3103 - DNA, 16 bp, Artificial sequence
  Synthetic oligonucleotide
atattttaaagtctcg

SEQ ID NO: 3104 - DNA, 16 bp, Artificial sequence
  Synthetic oligonucleotide
gttacattattataga

SEQ ID NO: 3105 - DNA, 16 bp, Artificial sequence
  Synthetic oligonucleotide
gtgaaatgtgttacat

SEQ ID NO: 3106 - DNA, 16 bp, Artificial sequence
  Synthetic oligonucleotide
tcaccagtgaaatgtg

SEQ ID NO: 3107 - DNA, 16 bp, Artificial sequence
  Synthetic oligonucleotide
catgtttcaccagtga

SEQ ID NO: 3108 - DNA, 16 bp, Artificial sequence
  Synthetic oligonucleotide
acaagacatgtttcac

SEQ ID NO: 3109 - DNA, 16 bp, Artificial sequence
  Synthetic oligonucleotide
catatgacaagacatg

SEQ ID NO: 3110 - DNA, 16 bp, Artificial sequence
  Synthetic oligonucleotide
ctataatgcatatgac

SEQ ID NO: 3111 - DNA, 16 bp, Artificial sequence
  Synthetic oligonucleotide
tcctttctataatgca

SEQ ID NO: 3112 - DNA, 16 bp, Artificial sequence
  Synthetic oligonucleotide
tgattatcctttctat

SEQ ID NO: 3113 - DNA, 16 bp, Artificial sequence
  Synthetic oligonucleotide
taactgaaagtctgat

SEQ ID NO: 3114 - DNA, 16 bp, Artificial sequence
  Synthetic oligonucleotide
gtgcacaaaaatgtta

SEQ ID NO: 3115 - DNA, 16 bp, Artificial sequence
  Synthetic oligonucleotide
agctatgtgcacaaaa

SEQ ID NO: 3116 - DNA, 16 bp, Artificial sequence
  Synthetic oligonucleotide
gaagatagctatgtgc

SEQ ID NO: 3117 - DNA, 16 bp, Artificial sequence
  Synthetic oligonucleotide
tttattgaagatagct

SEQ ID NO: 3118 - DNA, 16 bp, Artificial sequence
  Synthetic oligonucleotide
tcattttagtgtatct

SEQ ID NO: 3119 - DNA, 16 bp, Artificial sequence
  Synthetic oligonucleotide
ccttgatcattttagt

SEQ ID NO: 3120 - DNA, 16 bp, Artificial sequence
  Synthetic oligonucleotide
tgaatcccttgatcat

SEQ ID NO: 3121 - DNA, 16 bp, Artificial sequence
  Synthetic oligonucleotide
gttgtttagtcttgaa

SEQ ID NO: 3122 - DNA, 16 bp, Artificial sequence
  Synthetic oligonucleotide
aattgagttgtttagt

SEQ ID NO: 3123 - DNA, 16 bp, Artificial sequence
  Synthetic oligonucleotide
gcaactaattgagttg

SEQ ID NO: 3124 - DNA, 16 bp, Artificial sequence
  Synthetic oligonucleotide
attggtgcaactaatt

SEQ ID NO: 3125 - DNA, 16 bp, Artificial sequence
  Synthetic oligonucleotide
gttttttattggtgca

SEQ ID NO: 3126 - DNA, 16 bp, Artificial sequence
  Synthetic oligonucleotide
ggacactgacagtttt

SEQ ID NO: 3127 - DNA, 16 bp, Artificial sequence
  Synthetic oligonucleotide
caggttggacactgac

SEQ ID NO: 3128 - DNA, 16 bp, Artificial sequence
  Synthetic oligonucleotide
taagtacaggttggac

SEQ ID NO: 3129 - DNA, 16 bp, Artificial sequence
  Synthetic oligonucleotide
agttattaagtacagg

SEQ ID NO: 3130 - DNA, 16 bp, Artificial sequence
  Synthetic oligonucleotide
tctgtgagttattaag

SEQ ID NO: 3131 - DNA, 16 bp, Artificial sequence
  Synthetic oligonucleotide
accaaaattctcctga

SEQ ID NO: 3132 - DNA, 16 bp, Artificial sequence
  Synthetic oligonucleotide
acctgaataaccctct

SEQ ID NO: 3133 - DNA, 16 bp, Artificial sequence
  Synthetic oligonucleotide
ggtatcagaaaaagat

SEQ ID NO: 3134 - DNA, 16 bp, Artificial sequence
  Synthetic oligonucleotide
agtattggtatcagaa

SEQ ID NO: 3135 - DNA, 16 bp, Artificial sequence
  Synthetic oligonucleotide
ggaagatactttgaag

SEQ ID NO: 3136 - DNA, 16 bp, Artificial sequence
  Synthetic oligonucleotide
aatgtgggaagatact

SEQ ID NO: 3137 - DNA, 16 bp, Artificial sequence
  Synthetic oligonucleotide
cagataatagctaata

SEQ ID NO: 3138 - DNA, 16 bp, Artificial sequence
  Synthetic oligonucleotide
tcattgcagataatag

SEQ ID NO: 3139 - DNA, 16 bp, Artificial sequence
  Synthetic oligonucleotide
gattcggatttttaaa

SEQ ID NO: 3140 - DNA, 16 bp, Artificial sequence
  Synthetic oligonucleotide
atttgggattcggatt

SEQ ID NO: 3141 - DNA, 16 bp, Artificial sequence
  Synthetic oligonucleotide
acgcttatttgggatt

SEQ ID NO: 3142 - DNA, 16 bp, Artificial sequence
  Synthetic oligonucleotide
tctagagagaaaacgc

SEQ ID NO: 3143 - DNA, 16 bp, Artificial sequence
  Synthetic oligonucleotide
agttaagaggttttcg

SEQ ID NO: 3144 - DNA, 16 bp, Artificial sequence
  Synthetic oligonucleotide
cattatagttaagagg

SEQ ID NO: 3145 - DNA, 16 bp, Artificial sequence
  Synthetic oligonucleotide
cactttcattatagtt

SEQ ID NO: 3146 - DNA, 16 bp, Artificial sequence
  Synthetic oligonucleotide
tagaatgaacactttc

SEQ ID NO: 3147 - DNA, 16 bp, Artificial sequence
  Synthetic oligonucleotide
ttgaactagaatgaac

SEQ ID NO: 3148 - DNA, 16 bp, Artificial sequence
  Synthetic oligonucleotide
acctgattgaactaga

SEQ ID NO: 3149 - DNA, 16 bp, Artificial sequence
  Synthetic oligonucleotide
taaaatacctgattga

SEQ ID NO: 3150 - DNA, 16 bp, Artificial sequence
  Synthetic oligonucleotide
tagaggtaaaatacct

SEQ ID NO: 3151 - DNA, 16 bp, Artificial sequence
  Synthetic oligonucleotide
gaagattagaggtaaa

SEQ ID NO: 3152 - DNA, 16 bp, Artificial sequence
  Synthetic oligonucleotide
tctgaggaagattaga

SEQ ID NO: 3153 - DNA, 16 bp, Artificial sequence
  Synthetic oligonucleotide
tatacactaccaaaaa

SEQ ID NO: 3154 - DNA, 16 bp, Artificial sequence
  Synthetic oligonucleotide
ataatctatacactac

SEQ ID NO: 3155 - DNA, 16 bp, Artificial sequence
  Synthetic oligonucleotide
taagtcccaattttaa

SEQ ID NO: 3156 - DNA, 16 bp, Artificial sequence
  Synthetic oligonucleotide
ccagttttaaataatc

SEQ ID NO: 3157 - DNA, 16 bp, Artificial sequence
  Synthetic oligonucleotide
tgtatcccagttttaa

SEQ ID NO: 3158 - DNA, 16 bp, Artificial sequence
  Synthetic oligonucleotide
gttttagatgcatgta

SEQ ID NO: 3159 - DNA, 16 bp, Artificial sequence
  Synthetic oligonucleotide
tacagtgttttagatg

SEQ ID NO: 3160 - DNA, 16 bp, Artificial sequence
  Synthetic oligonucleotide
ttccccgtaagtttat

SEQ ID NO: 3161 - DNA, 16 bp, Artificial sequence
  Synthetic oligonucleotide
ctgtatttccccgtaa

SEQ ID NO: 3162 - DNA, 16 bp, Artificial sequence
  Synthetic oligonucleotide
tagttactgttactgt

SEQ ID NO: 3163 - DNA, 16 bp, Artificial sequence
  Synthetic oligonucleotide
cgtatgtagttactgt

SEQ ID NO: 3164 - DNA, 16 bp, Artificial sequence
  Synthetic oligonucleotide
aatgggtacagactcg

SEQ ID NO: 3165 - DNA, 16 bp, Artificial sequence
  Synthetic oligonucleotide
gcaatttaatgggtac

SEQ ID NO: 3166 - DNA, 16 bp, Artificial sequence
  Synthetic oligonucleotide
gatagatatgcaattt

SEQ ID NO: 3167 - DNA, 16 bp, Artificial sequence
  Synthetic oligonucleotide
aaaggagatagatatg

SEQ ID NO: 3168 - DNA, 16 bp, Artificial sequence
  Synthetic oligonucleotide
cctcctaaaggagata

SEQ ID NO: 3169 - DNA, 16 bp, Artificial sequence
  Synthetic oligonucleotide
caccagcctcctaaag

SEQ ID NO: 3170 - DNA, 16 bp, Artificial sequence
  Synthetic oligonucleotide
tttgtgatcccaagta

SEQ ID NO: 3171 - DNA, 16 bp, Artificial sequence
  Synthetic oligonucleotide
gctttgtgatcccaag

SEQ ID NO: 3172 - DNA, 16 bp, Artificial sequence
  Synthetic oligonucleotide
ttgctttgtgatccca

SEQ ID NO: 3173 - DNA, 16 bp, Artificial sequence
  Synthetic oligonucleotide
ttttgctttgtgatcc

SEQ ID NO: 3174 - DNA, 16 bp, Artificial sequence
  Synthetic oligonucleotide
ccttttgctttgtgat

SEQ ID NO: 3175 - DNA, 16 bp, Artificial sequence
  Synthetic oligonucleotide
gtccttttgctttgtg

SEQ ID NO: 3176 - DNA, 16 bp, Artificial sequence
  Synthetic oligonucleotide
gtgtccttttgctttg

SEQ ID NO: 3177 - DNA, 16 bp, Artificial sequence
  Synthetic oligonucleotide
gaaatgtaaacggtat

SEQ ID NO: 3178 - DNA, 16 bp, Artificial sequence
  Synthetic oligonucleotide
ttgagaaatgtaaacg

SEQ ID NO: 3179 - DNA, 16 bp, Artificial sequence
  Synthetic oligonucleotide
tgattgagaaatgtaa

SEQ ID NO: 3180 - DNA, 16 bp, Artificial sequence
  Synthetic oligonucleotide
tttgattgagaaatgt

SEQ ID NO: 3181 - DNA, 16 bp, Artificial sequence
  Synthetic oligonucleotide
aagaattttgattgag

SEQ ID NO: 3182 - DNA, 16 bp, Artificial sequence
  Synthetic oligonucleotide
ataagaattttgattg

SEQ ID NO: 3183 - DNA, 16 bp, Artificial sequence
  Synthetic oligonucleotide
caaatagtattataag

SEQ ID NO: 3184 - DNA, 16 bp, Artificial sequence
  Synthetic oligonucleotide
cccacatcacaaaatt

SEQ ID NO: 3185 - DNA, 16 bp, Artificial sequence
  Synthetic oligonucleotide
gattcccacatcacaa

SEQ ID NO: 3186 - DNA, 16 bp, Artificial sequence
  Synthetic oligonucleotide
ttgattcccacatcac

SEQ ID NO: 3187 - DNA, 16 bp, Artificial sequence
  Synthetic oligonucleotide
aattgattcccacatc

SEQ ID NO: 3188 - DNA, 16 bp, Artificial sequence
  Synthetic oligonucleotide
aaaattgattcccaca

SEQ ID NO: 3189 - DNA, 16 bp, Artificial sequence
  Synthetic oligonucleotide
ctaaaattgattccca

SEQ ID NO: 3190 - DNA, 16 bp, Artificial sequence
  Synthetic oligonucleotide
catctaaaattgattc

SEQ ID NO: 3191 - DNA, 16 bp, Artificial sequence
  Synthetic oligonucleotide
accatctaaaattgat

SEQ ID NO: 3192 - DNA, 16 bp, Artificial sequence
  Synthetic oligonucleotide
tgaccatctaaaattg

SEQ ID NO: 3193 - DNA, 16 bp, Artificial sequence
  Synthetic oligonucleotide
tgtgaccatctaaaat

SEQ ID NO: 3194 - DNA, 16 bp, Artificial sequence
  Synthetic oligonucleotide
attgtgaccatctaaa

SEQ ID NO: 3195 - DNA, 16 bp, Artificial sequence
  Synthetic oligonucleotide
agattgtgaccatcta

SEQ ID NO: 3196 - DNA, 16 bp, Artificial sequence
  Synthetic oligonucleotide
ctagattgtgaccatc

SEQ ID NO: 3197 - DNA, 16 bp, Artificial sequence
  Synthetic oligonucleotide
atctagattgtgacca

SEQ ID NO: 3198 - DNA, 16 bp, Artificial sequence
  Synthetic oligonucleotide
taatctagattgtgac

SEQ ID NO: 3199 - DNA, 16 bp, Artificial sequence
  Synthetic oligonucleotide
tataatctagattgtg

SEQ ID NO: 3200 - DNA, 16 bp, Artificial sequence
  Synthetic oligonucleotide
attataatctagattg

SEQ ID NO: 3201 - DNA, 16 bp, Artificial sequence
  Synthetic oligonucleotide
tgattataatctagat

SEQ ID NO: 3202 - DNA, 16 bp, Artificial sequence
  Synthetic oligonucleotide
attgattataatctag

SEQ ID NO: 3203 - DNA, 16 bp, Artificial sequence
  Synthetic oligonucleotide
ctattgattataatct

SEQ ID NO: 3204 - DNA, 16 bp, Artificial sequence
  Synthetic oligonucleotide
acctattgattataat

SEQ ID NO: 3205 - DNA, 16 bp, Artificial sequence
  Synthetic oligonucleotide
tcacctattgattata

SEQ ID NO: 3206 - DNA, 16 bp, Artificial sequence
  Synthetic oligonucleotide
gttcacctattgatta

SEQ ID NO: 3207 - DNA, 16 bp, Artificial sequence
  Synthetic oligonucleotide
aagttcacctattgat

SEQ ID NO: 3208 - DNA, 16 bp, Artificial sequence
  Synthetic oligonucleotide
ataagttcacctattg

SEQ ID NO: 3209 - DNA, 16 bp, Artificial sequence
  Synthetic oligonucleotide
taataagttcacctat

SEQ ID NO: 3210 - DNA, 16 bp, Artificial sequence
  Synthetic oligonucleotide
tttaataagttcacct

SEQ ID NO: 3211 - DNA, 16 bp, Artificial sequence
  Synthetic oligonucleotide
tatttaataagttcac

SEQ ID NO: 3212 - DNA, 16 bp, Artificial sequence
  Synthetic oligonucleotide
gttatttaataagttc

SEQ ID NO: 3213 - DNA, 16 bp, Artificial sequence
  Synthetic oligonucleotide
catatgatgcctttta

SEQ ID NO: 3214 - DNA, 16 bp, Artificial sequence
  Synthetic oligonucleotide
tattagctcatatgat

SEQ ID NO: 3215 - DNA, 16 bp, Artificial sequence
  Synthetic oligonucleotide
gatattagctcatatg

SEQ ID NO: 3216 - DNA, 16 bp, Artificial sequence
  Synthetic oligonucleotide
gtgatattagctcata

SEQ ID NO: 3217 - DNA, 16 bp, Artificial sequence
  Synthetic oligonucleotide
agttgtgatattagct

SEQ ID NO: 3218 - DNA, 16 bp, Artificial sequence
  Synthetic oligonucleotide
aaagttgtgatattag

SEQ ID NO: 3219 - DNA, 16 bp, Artificial sequence
  Synthetic oligonucleotide
ggaaagttgtgatatt

SEQ ID NO: 3220 - DNA, 16 bp, Artificial sequence
  Synthetic oligonucleotide
tgggaaagttgtgata

SEQ ID NO: 3221 - DNA, 16 bp, Artificial sequence
  Synthetic oligonucleotide
aaactgggaaagttgt

SEQ ID NO: 3222 - DNA, 16 bp, Artificial sequence
  Synthetic oligonucleotide
ttaaactgggaaagtt

SEQ ID NO: 3223 - DNA, 16 bp, Artificial sequence
  Synthetic oligonucleotide
gttttttaaactggga

SEQ ID NO: 3224 - DNA, 16 bp, Artificial sequence
  Synthetic oligonucleotide
tagttttttaaactgg

SEQ ID NO: 3225 - DNA, 16 bp, Artificial sequence
  Synthetic oligonucleotide
gagtactagtttttta

SEQ ID NO: 3226 - DNA, 16 bp, Artificial sequence
  Synthetic oligonucleotide
aagagtactagttttt

SEQ ID NO: 3227 - DNA, 16 bp, Artificial sequence
  Synthetic oligonucleotide
acaagagtactagttt

SEQ ID NO: 3228 - DNA, 16 bp, Artificial sequence
  Synthetic oligonucleotide
taacaagagtactagt

SEQ ID NO: 3229 - DNA, 16 bp, Artificial sequence
  Synthetic oligonucleotide
tttaacaagagtacta

SEQ ID NO: 3230 - DNA, 16 bp, Artificial sequence
  Synthetic oligonucleotide
gttttaacaagagtac

SEQ ID NO: 3231 - DNA, 16 bp, Artificial sequence
  Synthetic oligonucleotide
gagttttaacaagagt

SEQ ID NO: 3232 - DNA, 16 bp, Artificial sequence
  Synthetic oligonucleotide
tagagttttaacaaga

SEQ ID NO: 3233 - DNA, 16 bp, Artificial sequence
  Synthetic oligonucleotide
gtttagagttttaaca

SEQ ID NO: 3234 - DNA, 16 bp, Artificial sequence
  Synthetic oligonucleotide
caagtttagagtttta

SEQ ID NO: 3235 - DNA, 16 bp, Artificial sequence
  Synthetic oligonucleotide
gtcaagtttagagttt

SEQ ID NO: 3236 - DNA, 16 bp, Artificial sequence
  Synthetic oligonucleotide
tagtcaagtttagagt

SEQ ID NO: 3237 - DNA, 16 bp, Artificial sequence
  Synthetic oligonucleotide
tttagtcaagtttaga

SEQ ID NO: 3238 - DNA, 16 bp, Artificial sequence
  Synthetic oligonucleotide
tatttagtcaagttta

SEQ ID NO: 3239 - DNA, 16 bp, Artificial sequence
  Synthetic oligonucleotide
tgtatttagtcaagtt

SEQ ID NO: 3240 - DNA, 16 bp, Artificial sequence
  Synthetic oligonucleotide
tctgtatttagtcaag

SEQ ID NO: 3241 - DNA, 16 bp, Artificial sequence
  Synthetic oligonucleotide
cctctgtatttagtca

SEQ ID NO: 3242 - DNA, 16 bp, Artificial sequence
  Synthetic oligonucleotide
gtcctctgtatttagt

SEQ ID NO: 3243 - DNA, 16 bp, Artificial sequence
  Synthetic oligonucleotide
cagtcctctgtattta

SEQ ID NO: 3244 - DNA, 16 bp, Artificial sequence
  Synthetic oligonucleotide
accagtcctctgtatt

SEQ ID NO: 3245 - DNA, 16 bp, Artificial sequence
  Synthetic oligonucleotide
ttaccagtcctctgta

SEQ ID NO: 3246 - DNA, 16 bp, Artificial sequence
  Synthetic oligonucleotide
aattaccagtcctctg

SEQ ID NO: 3247 - DNA, 16 bp, Artificial sequence
  Synthetic oligonucleotide
acaattaccagtcctc

SEQ ID NO: 3248 - DNA, 16 bp, Artificial sequence
  Synthetic oligonucleotide
tctgacaagattcctt

SEQ ID NO: 3249 - DNA, 16 bp, Artificial sequence
  Synthetic oligonucleotide
atctgacaagattcct

SEQ ID NO: 3250 - DNA, 16 bp, Artificial sequence
  Synthetic oligonucleotide
taatctgacaagattc

SEQ ID NO: 3251 - DNA, 16 bp, Artificial sequence
  Synthetic oligonucleotide
gtaatctgacaagatt

SEQ ID NO: 3252 - DNA, 16 bp, Artificial sequence
  Synthetic oligonucleotide
cttgtcaggctgttta

SEQ ID NO: 3253 - DNA, 16 bp, Artificial sequence
  Synthetic oligonucleotide
gcttgtcaggctgttt

SEQ ID NO: 3254 - DNA, 16 bp, Artificial sequence
  Synthetic oligonucleotide
atgcttgtcaggctgt

SEQ ID NO: 3255 - DNA, 16 bp, Artificial sequence
  Synthetic oligonucleotide
tacatgcttgtcaggc

SEQ ID NO: 3256 - DNA, 16 bp, Artificial sequence
  Synthetic oligonucleotide
atacatgcttgtcagg

SEQ ID NO: 3257 - DNA, 16 bp, Artificial sequence
  Synthetic oligonucleotide
aaaggtaggtcaccat

SEQ ID NO: 3258 - DNA, 16 bp, Artificial sequence
  Synthetic oligonucleotide
caaaggtaggtcacca

SEQ ID NO: 3259 - DNA, 16 bp, Artificial sequence
  Synthetic oligonucleotide
gacaaaggtaggtcac

SEQ ID NO: 3260 - DNA, 16 bp, Artificial sequence
  Synthetic oligonucleotide
tgacaaaggtaggtca

SEQ ID NO: 3261 - DNA, 16 bp, Artificial sequence
  Synthetic oligonucleotide
tctgacatagcttttt

SEQ ID NO: 3262 - DNA, 16 bp, Artificial sequence
  Synthetic oligonucleotide
attctgacatagcttt

SEQ ID NO: 3263 - DNA, 16 bp, Artificial sequence
  Synthetic oligonucleotide
gattctgacatagctt

SEQ ID NO: 3264 - DNA, 16 bp, Artificial sequence
  Synthetic oligonucleotide
ggattctgacatagct

SEQ ID NO: 3265 - DNA, 16 bp, Artificial sequence
  Synthetic oligonucleotide
atggattctgacatag

SEQ ID NO: 3266 - DNA, 16 bp, Artificial sequence
  Synthetic oligonucleotide
catggattctgacata

SEQ ID NO: 3267 - DNA, 16 bp, Artificial sequence
  Synthetic oligonucleotide
acatggattctgacat

SEQ ID NO: 3268 - DNA, 16 bp, Artificial sequence
  Synthetic oligonucleotide
tacatggattctgaca

SEQ ID NO: 3269 - DNA, 16 bp, Artificial sequence
  Synthetic oligonucleotide
atacatggattctgac

SEQ ID NO: 3270 - DNA, 16 bp, Artificial sequence
  Synthetic oligonucleotide
tttagcagcactacta

SEQ ID NO: 3271 - DNA, 16 bp, Artificial sequence
  Synthetic oligonucleotide
ttttagcagcactact

SEQ ID NO: 3272 - DNA, 16 bp, Artificial sequence
  Synthetic oligonucleotide
cttttagcagcactac

SEQ ID NO: 3273 - DNA, 16 bp, Artificial sequence
  Synthetic oligonucleotide
aaaaccttttagcagc

SEQ ID NO: 3274 - DNA, 16 bp, Artificial sequence
  Synthetic oligonucleotide
gataaaaaacctttta

SEQ ID NO: 3275 - DNA, 16 bp, Artificial sequence
  Synthetic oligonucleotide
tgataaaaaacctttt

SEQ ID NO: 3276 - DNA, 16 bp, Artificial sequence
  Synthetic oligonucleotide
agatgttggcaggttg

SEQ ID NO: 3277 - DNA, 16 bp, Artificial sequence
  Synthetic oligonucleotide
tagatgttggcaggtt

SEQ ID NO: 3278 - DNA, 16 bp, Artificial sequence
  Synthetic oligonucleotide
gtagatgttggcaggt

SEQ ID NO: 3279 - DNA, 16 bp, Artificial sequence
  Synthetic oligonucleotide
tgtagatgttggcagg

SEQ ID NO: 3280 - DNA, 16 bp, Artificial sequence
  Synthetic oligonucleotide
ctgtagatgttggcag

SEQ ID NO: 3281 - DNA, 16 bp, Artificial sequence
  Synthetic oligonucleotide
tatctgtagatgttgg

SEQ ID NO: 3282 - DNA, 16 bp, Artificial sequence
  Synthetic oligonucleotide
atatctgtagatgttg

SEQ ID NO: 3283 - DNA, 16 bp, Artificial sequence
  Synthetic oligonucleotide
catatctgtagatgtt

SEQ ID NO: 3284 - DNA, 16 bp, Artificial sequence
  Synthetic oligonucleotide
tttgaaccaggctttc

SEQ ID NO: 3285 - DNA, 16 bp, Artificial sequence
  Synthetic oligonucleotide
aatttgaaccaggctt

SEQ ID NO: 3286 - DNA, 16 bp, Artificial sequence
  Synthetic oligonucleotide
cataatttgaaccagg

SEQ ID NO: 3287 - DNA, 16 bp, Artificial sequence
  Synthetic oligonucleotide
acataatttgaaccag

SEQ ID NO: 3288 - DNA, 16 bp, Artificial sequence
  Synthetic oligonucleotide
tacataatttgaacca

SEQ ID NO: 3289 - DNA, 16 bp, Artificial sequence
  Synthetic oligonucleotide
atacataatttgaacc

SEQ ID NO: 3290 - DNA, 16 bp, Artificial sequence
  Synthetic oligonucleotide
acattggtcggaaaac

SEQ ID NO: 3291 - DNA, 16 bp, Artificial sequence
  Synthetic oligonucleotide
gacattggtcggaaaa

SEQ ID NO: 3292 - DNA, 16 bp, Artificial sequence
  Synthetic oligonucleotide
agacattggtcggaaa

SEQ ID NO: 3293 - DNA, 16 bp, Artificial sequence
  Synthetic oligonucleotide
cagacattggtcggaa

SEQ ID NO: 3294 - DNA, 16 bp, Artificial sequence
  Synthetic oligonucleotide
gcagacattggtcgga

SEQ ID NO: 3295 - DNA, 16 bp, Artificial sequence
  Synthetic oligonucleotide
aagcagacattggtcg

SEQ ID NO: 3296 - DNA, 16 bp, Artificial sequence
  Synthetic oligonucleotide
tgtacagattacctgt

SEQ ID NO: 3297 - DNA, 16 bp, Artificial sequence
  Synthetic oligonucleotide
ttgtacagattacctg

SEQ ID NO: 3298 - DNA, 16 bp, Artificial sequence
  Synthetic oligonucleotide
attgtacagattacct

SEQ ID NO: 3299 - DNA, 16 bp, Artificial sequence
  Synthetic oligonucleotide
gattgtacagattacc

SEQ ID NO: 3300 - DNA, 16 bp, Artificial sequence
  Synthetic oligonucleotide
agattgtacagattac

SEQ ID NO: 3301 - DNA, 16 bp, Artificial sequence
  Synthetic oligonucleotide
tcagattgtacagatt

SEQ ID NO: 3302 - DNA, 16 bp, Artificial sequence
  Synthetic oligonucleotide
ttcagattgtacagat

SEQ ID NO: 3303 - DNA, 16 bp, Artificial sequence
  Synthetic oligonucleotide
attcagattgtacaga

SEQ ID NO: 3304 - DNA, 16 bp, Artificial sequence
  Synthetic oligonucleotide
tattcagattgtacag

SEQ ID NO: 3305 - DNA, 16 bp, Artificial sequence
  Synthetic oligonucleotide
ttattcagattgtaca

SEQ ID NO: 3306 - DNA, 16 bp, Artificial sequence
  Synthetic oligonucleotide
taggtatgtcttttat

SEQ ID NO: 3307 - DNA, 16 bp, Artificial sequence
  Synthetic oligonucleotide
tgtcttaggtatgtct

SEQ ID NO: 3308 - DNA, 16 bp, Artificial sequence
  Synthetic oligonucleotide
attgtcttaggtatgt

SEQ ID NO: 3309 - DNA, 16 bp, Artificial sequence
  Synthetic oligonucleotide
gattgtcttaggtatg

SEQ ID NO: 3310 - DNA, 16 bp, Artificial sequence
  Synthetic oligonucleotide
ttcttagatggcgtgt

SEQ ID NO: 3311 - DNA, 16 bp, Artificial sequence
  Synthetic oligonucleotide
atttttcttagatggc

SEQ ID NO: 3312 - DNA, 16 bp, Artificial sequence
  Synthetic oligonucleotide
catttttcttagatgg

SEQ ID NO: 3313 - DNA, 16 bp, Artificial sequence
  Synthetic oligonucleotide
gcatttttcttagatg

SEQ ID NO: 3314 - DNA, 16 bp, Artificial sequence
  Synthetic oligonucleotide
ataagtcccaatttta

SEQ ID NO: 3315 - DNA, 16 bp, Artificial sequence
  Synthetic oligonucleotide
tataagtcccaatttt

SEQ ID NO: 3316 - DNA, 16 bp, Artificial sequence
  Synthetic oligonucleotide
gtataagtcccaattt

SEQ ID NO: 3317 - DNA, 16 bp, Artificial sequence
  Synthetic oligonucleotide
tgtataagtcccaatt

SEQ ID NO: 3318 - DNA, 16 bp, Artificial sequence
  Synthetic oligonucleotide
ctgtataagtcccaat

SEQ ID NO: 3319 - DNA, 16 bp, Artificial sequence
  Synthetic oligonucleotide
taatctgtataagtcc

SEQ ID NO: 3320 - DNA, 16 bp, Artificial sequence
  Synthetic oligonucleotide
ataatctgtataagtc

SEQ ID NO: 3321 - DNA, 16 bp, Artificial sequence
  Synthetic oligonucleotide
aataatctgtataagt

SEQ ID NO: 3322 - DNA, 16 bp, Artificial sequence
  Synthetic oligonucleotide
tgcatgtatcccagtt

SEQ ID NO: 3323 - DNA, 16 bp, Artificial sequence
  Synthetic oligonucleotide
tagatgcatgtatccc

SEQ ID NO: 3324 - DNA, 16 bp, Artificial sequence
  Synthetic oligonucleotide
ttagatgcatgtatcc

SEQ ID NO: 3325 - DNA, 16 bp, Artificial sequence
  Synthetic oligonucleotide
tttagatgcatgtatc

SEQ ID NO: 3326 - DNA, 16 bp, Artificial sequence
  Synthetic oligonucleotide
gtggaactgttttctt

SEQ ID NO: 3327 - DNA, 16 bp, Artificial sequence
  Synthetic oligonucleotide
acgtggaactgttttc

SEQ ID NO: 3328 - DNA, 16 bp, Artificial sequence
  Synthetic oligonucleotide
ttgatcaattctggag

SEQ ID NO: 3329 - DNA, 16 bp, Artificial sequence
  Synthetic oligonucleotide
tcttgatcaattctgg

SEQ ID NO: 3330 - DNA, 16 bp, Artificial sequence
  Synthetic oligonucleotide
ggctctggagatagag

SEQ ID NO: 3331 - DNA, 16 bp, Artificial sequence
  Synthetic oligonucleotide
ttggctctggagatag

SEQ ID NO: 3332 - DNA, 16 bp, Artificial sequence
  Synthetic oligonucleotide
gattttggctctggag

SEQ ID NO: 3333 - DNA, 16 bp, Artificial sequence
  Synthetic oligonucleotide
tcttgattttggctct

SEQ ID NO: 3334 - DNA, 16 bp, Artificial sequence
  Synthetic oligonucleotide
aatcttgattttggct

SEQ ID NO: 3335 - DNA, 16 bp, Artificial sequence
  Synthetic oligonucleotide
caaatcttgattttgg

SEQ ID NO: 3336 - DNA, 16 bp, Artificial sequence
  Synthetic oligonucleotide
gcagcgatagatcata

SEQ ID NO: 3337 - DNA, 16 bp, Artificial sequence
  Synthetic oligonucleotide
ttgcagcgatagatca

SEQ ID NO: 3338 - DNA, 16 bp, Artificial sequence
  Synthetic oligonucleotide
tggtttgcagcgatag

SEQ ID NO: 3339 - DNA, 16 bp, Artificial sequence
  Synthetic oligonucleotide
tttgatttcactggtt

SEQ ID NO: 3340 - DNA, 16 bp, Artificial sequence
  Synthetic oligonucleotide
tctttgatttcactgg

SEQ ID NO: 3341 - DNA, 16 bp, Artificial sequence
  Synthetic oligonucleotide
agttcttctcagttcc

SEQ ID NO: 3342 - DNA, 16 bp, Artificial sequence
  Synthetic oligonucleotide
ttagttagttgctctt

SEQ ID NO: 3343 - DNA, 16 bp, Artificial sequence
  Synthetic oligonucleotide
agttagttagttgctc

SEQ ID NO: 3344 - DNA, 16 bp, Artificial sequence
  Synthetic oligonucleotide
gtgctcttggcttgga

SEQ ID NO: 3345 - DNA, 16 bp, Artificial sequence
  Synthetic oligonucleotide
tggtgctcttggcttg

SEQ ID NO: 3346 - DNA, 16 bp, Artificial sequence
  Synthetic oligonucleotide
tatgttcacctctgtt

SEQ ID NO: 3347 - DNA, 16 bp, Artificial sequence
  Synthetic oligonucleotide
tgtatgttcacctctg

SEQ ID NO: 3348 - DNA, 16 bp, Artificial sequence
  Synthetic oligonucleotide
acactcatcatgccac

SEQ ID NO: 3349 - DNA, 16 bp, Artificial sequence
  Synthetic oligonucleotide
ccacactcatcatgcc

SEQ ID NO: 3350 - DNA, 16 bp, Artificial sequence
  Synthetic oligonucleotide
ttagattttgctcttg

SEQ ID NO: 3351 - DNA, 16 bp, Artificial sequence
  Synthetic oligonucleotide
atagagtataaccttc

SEQ ID NO: 3352 - DNA, 16 bp, Artificial sequence
  Synthetic oligonucleotide
aatctgttggatggat

SEQ ID NO: 3353 - DNA, 16 bp, Artificial sequence
  Synthetic oligonucleotide
tgaatctgttggatgg

SEQ ID NO: 3354 - DNA, 16 bp, Artificial sequence
  Synthetic oligonucleotide
ttcattcaaagctttc

SEQ ID NO: 3355 - DNA, 16 bp, Artificial sequence
  Synthetic oligonucleotide
agttcattcaaagctt

SEQ ID NO: 3356 - DNA, 16 bp, Artificial sequence
  Synthetic oligonucleotide
tcagttcattcaaagc

SEQ ID NO: 3357 - DNA, 16 bp, Artificial sequence
  Synthetic oligonucleotide
gattattagaccacat

SEQ ID NO: 3358 - DNA, 16 bp, Artificial sequence
  Synthetic oligonucleotide
aatagacagtgacttt

SEQ ID NO: 3359 - DNA, 16 bp, Artificial sequence
  Synthetic oligonucleotide
agaaatgtaaacggta

SEQ ID NO: 3360 - DNA, 16 bp, Artificial sequence
  Synthetic oligonucleotide
tcatatgatgcctttt

SEQ ID NO: 3361 - DNA, 16 bp, Artificial sequence
  Synthetic oligonucleotide
attagctcatatgatg

SEQ ID NO: 3362 - DNA, 16 bp, Artificial sequence
  Synthetic oligonucleotide
tgtgatattagctcat

SEQ ID NO: 3363 - DNA, 16 bp, Artificial sequence
  Synthetic oligonucleotide
gttgtgatattagctc

SEQ ID NO: 3364 - DNA, 16 bp, Artificial sequence
  Synthetic oligonucleotide
tactctgtgctgacga

SEQ ID NO: 3365 - DNA, 16 bp, Artificial sequence
  Synthetic oligonucleotide
catactctgtgctgac

SEQ ID NO: 3366 - DNA, 16 bp, Artificial sequence
  Synthetic oligonucleotide
gtttaaagacagcgaa

SEQ ID NO: 3367 - DNA, 16 bp, Artificial sequence
  Synthetic oligonucleotide
ttgtttaaagacagcg

SEQ ID NO: 3368 - DNA, 16 bp, Artificial sequence
  Synthetic oligonucleotide
gtagtcatctccattt

SEQ ID NO: 3369 - DNA, 16 bp, Artificial sequence
  Synthetic oligonucleotide
tagtagtcatctccat

SEQ ID NO: 3370 - DNA, 16 bp, Artificial sequence
  Synthetic oligonucleotide
tcttaactctatatat

SEQ ID NO: 3371 - DNA, 16 bp, Artificial sequence
  Synthetic oligonucleotide
cttcttaactctatat

SEQ ID NO: 3372 - DNA, 16 bp, Artificial sequence
  Synthetic oligonucleotide
gacttcttaactctat

SEQ ID NO: 3373 - DNA, 16 bp, Artificial sequence
  Synthetic oligonucleotide
tagacttcttaactct

SEQ ID NO: 3374 - DNA, 16 bp, Artificial sequence
  Synthetic oligonucleotide
cctagacttcttaact

SEQ ID NO: 3375 - DNA, 16 bp, Artificial sequence
  Synthetic oligonucleotide
gacctagacttcttaa

SEQ ID NO: 3376 - DNA, 16 bp, Artificial sequence
  Synthetic oligonucleotide
cagacctagacttctt

SEQ ID NO: 3377 - DNA, 16 bp, Artificial sequence
  Synthetic oligonucleotide
agcagacctagacttc

SEQ ID NO: 3378 - DNA, 16 bp, Artificial sequence
  Synthetic oligonucleotide
gaagcagacctagact

SEQ ID NO: 3379 - DNA, 16 bp, Artificial sequence
  Synthetic oligonucleotide
tggaagcagacctaga

SEQ ID NO: 3380 - DNA, 16 bp, Artificial sequence
  Synthetic oligonucleotide
ctttaacaaatgggtt

SEQ ID NO: 3381 - DNA, 16 bp, Artificial sequence
  Synthetic oligonucleotide
atcctttaacaaatgg

SEQ ID NO: 3382 - DNA, 16 bp, Artificial sequence
  Synthetic oligonucleotide
ctatatcctttaacaa

SEQ ID NO: 3383 - DNA, 16 bp, Artificial sequence
  Synthetic oligonucleotide
gcactatatcctttaa

SEQ ID NO: 3384 - DNA, 16 bp, Artificial sequence
  Synthetic oligonucleotide
tgggcactatatcctt

SEQ ID NO: 3385 - DNA, 16 bp, Artificial sequence
  Synthetic oligonucleotide
acttgggcactatatc

SEQ ID NO: 3386 - DNA, 16 bp, Artificial sequence
  Synthetic oligonucleotide
ataacttgggcactat

SEQ ID NO: 3387 - DNA, 16 bp, Artificial sequence
  Synthetic oligonucleotide
catataacttgggcac

SEQ ID NO: 3388 - DNA, 16 bp, Artificial sequence
  Synthetic oligonucleotide
caccatataacttggg

SEQ ID NO: 3389 - DNA, 16 bp, Artificial sequence
  Synthetic oligonucleotide
ggtcaccatataactt

SEQ ID NO: 3390 - DNA, 16 bp, Artificial sequence
  Synthetic oligonucleotide
gtaggtcaccatataa

SEQ ID NO: 3391 - DNA, 16 bp, Artificial sequence
  Synthetic oligonucleotide
aaggtaggtcaccata

SEQ ID NO: 3392 - DNA, 16 bp, Artificial sequence
  Synthetic oligonucleotide
ttgacaaaggtaggtc

SEQ ID NO: 3393 - DNA, 16 bp, Artificial sequence
  Synthetic oligonucleotide
gtattgacaaaggtag

SEQ ID NO: 3394 - DNA, 16 bp, Artificial sequence
  Synthetic oligonucleotide
taagtattgacaaagg

SEQ ID NO: 3395 - DNA, 16 bp, Artificial sequence
  Synthetic oligonucleotide
tgctaagtattgacaa

SEQ ID NO: 3396 - DNA, 16 bp, Artificial sequence
  Synthetic oligonucleotide
taatgctaagtattga

SEQ ID NO: 3397 - DNA, 16 bp, Artificial sequence
  Synthetic oligonucleotide
tacataatgctaagta

SEQ ID NO: 3398 - DNA, 16 bp, Artificial sequence
  Synthetic oligonucleotide
ggataatttgaaatac

SEQ ID NO: 3399 - DNA, 16 bp, Artificial sequence
  Synthetic oligonucleotide
tattggataatttgaa

SEQ ID NO: 3400 - DNA, 16 bp, Artificial sequence
  Synthetic oligonucleotide
gtatattggataattt

SEQ ID NO: 3401 - DNA, 16 bp, Artificial sequence
  Synthetic oligonucleotide
catgtatattggataa

SEQ ID NO: 3402 - DNA, 16 bp, Artificial sequence
  Synthetic oligonucleotide
cttttatatatgtgac

SEQ ID NO: 3403 - DNA, 16 bp, Artificial sequence
  Synthetic oligonucleotide
gatcatacatatcttt

SEQ ID NO: 3404 - DNA, 16 bp, Artificial sequence
  Synthetic oligonucleotide
atagatcatacatatc

SEQ ID NO: 3405 - DNA, 16 bp, Artificial sequence
  Synthetic oligonucleotide
cacatagatcatacat

SEQ ID NO: 3406 - DNA, 16 bp, Artificial sequence
  Synthetic oligonucleotide
attcacatagatcata

SEQ ID NO: 3407 - DNA, 16 bp, Artificial sequence
  Synthetic oligonucleotide
aggattcacatagatc

SEQ ID NO: 3408 - DNA, 16 bp, Artificial sequence
  Synthetic oligonucleotide
cttaggattcacatag

SEQ ID NO: 3409 - DNA, 16 bp, Artificial sequence
  Synthetic oligonucleotide
ttacttaggattcaca

SEQ ID NO: 3410 - DNA, 16 bp, Artificial sequence
  Synthetic oligonucleotide
tatttacttaggattc

SEQ ID NO: 3411 - DNA, 16 bp, Artificial sequence
  Synthetic oligonucleotide
cctgaaaattatagat

SEQ ID NO: 3412 - DNA, 16 bp, Artificial sequence
  Synthetic oligonucleotide
ggtcctgaaaattata

SEQ ID NO: 3413 - DNA, 16 bp, Artificial sequence
  Synthetic oligonucleotide
tgtggtcctgaaaatt

SEQ ID NO: 3414 - DNA, 16 bp, Artificial sequence
  Synthetic oligonucleotide
gtctgtggtcctgaaa

SEQ ID NO: 3415 - DNA, 16 bp, Artificial sequence
  Synthetic oligonucleotide
ttagtctgtggtcctg

SEQ ID NO: 3416 - DNA, 16 bp, Artificial sequence
  Synthetic oligonucleotide
agcttagtctgtggtc

SEQ ID NO: 3417 - DNA, 16 bp, Artificial sequence
  Synthetic oligonucleotide
gacagcttagtctgtg

SEQ ID NO: 3418 - DNA, 16 bp, Artificial sequence
  Synthetic oligonucleotide
ttcgacagcttagtct

SEQ ID NO: 3419 - DNA, 16 bp, Artificial sequence
  Synthetic oligonucleotide
aatttcgacagcttag

SEQ ID NO: 3420 - DNA, 16 bp, Artificial sequence
  Synthetic oligonucleotide
gttaatttcgacagct

SEQ ID NO: 3421 - DNA, 16 bp, Artificial sequence
  Synthetic oligonucleotide
cctaaaaaaatcagcg

SEQ ID NO: 3422 - DNA, 16 bp, Artificial sequence
  Synthetic oligonucleotide
ggccctaaaaaaatca

SEQ ID NO: 3423 - DNA, 16 bp, Artificial sequence
  Synthetic oligonucleotide
ttctggccctaaaaaa

SEQ ID NO: 3424 - DNA, 16 bp, Artificial sequence
  Synthetic oligonucleotide
gtattctggccctaaa

SEQ ID NO: 3425 - DNA, 16 bp, Artificial sequence
  Synthetic oligonucleotide
ttggtattctggccct

SEQ ID NO: 3426 - DNA, 16 bp, Artificial sequence
  Synthetic oligonucleotide
attttggtattctggc

SEQ ID NO: 3427 - DNA, 16 bp, Artificial sequence
  Synthetic oligonucleotide
gccattttggtattct

SEQ ID NO: 3428 - DNA, 16 bp, Artificial sequence
  Synthetic oligonucleotide
ggagccattttggtat

SEQ ID NO: 3429 - DNA, 16 bp, Artificial sequence
  Synthetic oligonucleotide
agaggagccattttgg

SEQ ID NO: 3430 - DNA, 16 bp, Artificial sequence
  Synthetic oligonucleotide
aagagaggagccattt

SEQ ID NO: 3431 - DNA, 16 bp, Artificial sequence
  Synthetic oligonucleotide
attgtccaattttggg

SEQ ID NO: 3432 - DNA, 16 bp, Artificial sequence
  Synthetic oligonucleotide
gaaattgtccaatttt

SEQ ID NO: 3433 - DNA, 16 bp, Artificial sequence
  Synthetic oligonucleotide
tttgaaattgtccaat

SEQ ID NO: 3434 - DNA, 16 bp, Artificial sequence
  Synthetic oligonucleotide
gcatttgaaattgtcc

SEQ ID NO: 3435 - DNA, 16 bp, Artificial sequence
  Synthetic oligonucleotide
gcaactcatatattaa

SEQ ID NO: 3436 - DNA, 16 bp, Artificial sequence
  Synthetic oligonucleotide
gaagcaactcatatat

SEQ ID NO: 3437 - DNA, 16 bp, Artificial sequence
  Synthetic oligonucleotide
gaggaagcaactcata

SEQ ID NO: 3438 - DNA, 16 bp, Artificial sequence
  Synthetic oligonucleotide
atagaggaagcaactc

SEQ ID NO: 3439 - DNA, 16 bp, Artificial sequence
  Synthetic oligonucleotide
caaatagaggaagcaa

SEQ ID NO: 3440 - DNA, 16 bp, Artificial sequence
  Synthetic oligonucleotide
aaccaaatagaggaag

SEQ ID NO: 3441 - DNA, 16 bp, Artificial sequence
  Synthetic oligonucleotide
ggaaaccaaatagagg

SEQ ID NO: 3442 - DNA, 16 bp, Artificial sequence
  Synthetic oligonucleotide
ctttaagtgaagttac

SEQ ID NO: 3443 - DNA, 16 bp, Artificial sequence
  Synthetic oligonucleotide
tacttactttaagtga

SEQ ID NO: 3444 - DNA, 16 bp, Artificial sequence
  Synthetic oligonucleotide
gaaccctctttatttt

SEQ ID NO: 3445 - DNA, 16 bp, Artificial sequence
  Synthetic oligonucleotide
aaacatgaaccctctt

SEQ ID NO: 3446 - DNA, 16 bp, Artificial sequence
  Synthetic oligonucleotide
gatccacattgaaaac

SEQ ID NO: 3447 - DNA, 16 bp, Artificial sequence
  Synthetic oligonucleotide
catgccttagaaatat

SEQ ID NO: 3448 - DNA, 16 bp, Artificial sequence
  Synthetic oligonucleotide
aaatggcatgccttag

SEQ ID NO: 3449 - DNA, 16 bp, Artificial sequence
  Synthetic oligonucleotide
gtatttcaaatggcat

SEQ ID NO: 3450 - DNA, 16 bp, Artificial sequence
  Synthetic oligonucleotide
gcaacaaagtatttca

SEQ ID NO: 3451 - DNA, 16 bp, Artificial sequence
  Synthetic oligonucleotide
gtatttcaacaatgca

SEQ ID NO: 3452 - DNA, 16 bp, Artificial sequence
  Synthetic oligonucleotide
ataacattagggaaac

SEQ ID NO: 3453 - DNA, 16 bp, Artificial sequence
  Synthetic oligonucleotide
tcatatataacattag

SEQ ID NO: 3454 - DNA, 16 bp, Artificial sequence
  Synthetic oligonucleotide
gtggttttgagcaaag

SEQ ID NO: 3455 - DNA, 16 bp, Artificial sequence
  Synthetic oligonucleotide
ctattgtgtggttttg

SEQ ID NO: 3456 - DNA, 16 bp, Artificial sequence
  Synthetic oligonucleotide
ggaaagctattgtgtg

SEQ ID NO: 3457 - DNA, 16 bp, Artificial sequence
  Synthetic oligonucleotide
tatgagtgaaatggaa

SEQ ID NO: 3458 - DNA, 16 bp, Artificial sequence
  Synthetic oligonucleotide
agccaatatgagtgaa

SEQ ID NO: 3459 - DNA, 16 bp, Artificial sequence
  Synthetic oligonucleotide
ctaaagagccaatatg

SEQ ID NO: 3460 - DNA, 16 bp, Artificial sequence
  Synthetic oligonucleotide
ggtaatcttggtctaa

SEQ ID NO: 3461 - DNA, 16 bp, Artificial sequence
  Synthetic oligonucleotide
gatgacgaagggttgg

SEQ ID NO: 3462 - DNA, 16 bp, Artificial sequence
  Synthetic oligonucleotide
cagtgagatgacgaag

SEQ ID NO: 3463 - DNA, 16 bp, Artificial sequence
  Synthetic oligonucleotide
tgaagtcagtgagatg

SEQ ID NO: 3464 - DNA, 16 bp, Artificial sequence
  Synthetic oligonucleotide
aggaggtgaagtcagt

SEQ ID NO: 3465 - DNA, 16 bp, Artificial sequence
  Synthetic oligonucleotide
gagtagaggaggtgaa

SEQ ID NO: 3466 - DNA, 16 bp, Artificial sequence
  Synthetic oligonucleotide
taactagagtagagga

SEQ ID NO: 3467 - DNA, 16 bp, Artificial sequence
  Synthetic oligonucleotide
tcagaataactagagt

SEQ ID NO: 3468 - DNA, 16 bp, Artificial sequence
  Synthetic oligonucleotide
aagcggtcagaataac

SEQ ID NO: 3469 - DNA, 16 bp, Artificial sequence
  Synthetic oligonucleotide
ctggtaaagcggtcag

SEQ ID NO: 3470 - DNA, 16 bp, Artificial sequence
  Synthetic oligonucleotide
tgaatactggtaaagc

SEQ ID NO: 3471 - DNA, 16 bp, Artificial sequence
  Synthetic oligonucleotide
tgtgtttgaatactgg

SEQ ID NO: 3472 - DNA, 16 bp, Artificial sequence
  Synthetic oligonucleotide
gtttgatgtgtttgaa

SEQ ID NO: 3473 - DNA, 16 bp, Artificial sequence
  Synthetic oligonucleotide
cagtatgtttgatgtg

SEQ ID NO: 3474 - DNA, 16 bp, Artificial sequence
  Synthetic oligonucleotide
aggtggcagtatgttt

SEQ ID NO: 3475 - DNA, 16 bp, Artificial sequence
  Synthetic oligonucleotide
gctttgaggtggcagt

SEQ ID NO: 3476 - DNA, 16 bp, Artificial sequence
  Synthetic oligonucleotide
gggcaaaggctttgag

SEQ ID NO: 3477 - DNA, 16 bp, Artificial sequence
  Synthetic oligonucleotide
caacaagggcaaaggc

SEQ ID NO: 3478 - DNA, 16 bp, Artificial sequence
  Synthetic oligonucleotide
gaggaaacaacaaggg

SEQ ID NO: 3479 - DNA, 16 bp, Artificial sequence
  Synthetic oligonucleotide
ccagttagaggaaaca

SEQ ID NO: 3480 - DNA, 16 bp, Artificial sequence
  Synthetic oligonucleotide
ccagggcagaagagcg

SEQ ID NO: 3481 - DNA, 16 bp, Artificial sequence
  Synthetic oligonucleotide
tagataccagggcaga

SEQ ID NO: 3482 - DNA, 16 bp, Artificial sequence
  Synthetic oligonucleotide
cagagagtgggccacg

SEQ ID NO: 3483 - DNA, 16 bp, Artificial sequence
  Synthetic oligonucleotide
ggaaatcagagagtgg

SEQ ID NO: 3484 - DNA, 16 bp, Artificial sequence
  Synthetic oligonucleotide
cctaagggaaatcaga

SEQ ID NO: 3485 - DNA, 16 bp, Artificial sequence
  Synthetic oligonucleotide
aacgaccctaagggaa

SEQ ID NO: 3486 - DNA, 16 bp, Artificial sequence
  Synthetic oligonucleotide
tttgataacgacccta

SEQ ID NO: 3487 - DNA, 16 bp, Artificial sequence
  Synthetic oligonucleotide
tttttgtttgataacg

SEQ ID NO: 3488 - DNA, 16 bp, Artificial sequence
  Synthetic oligonucleotide
cattgggaattttttg

SEQ ID NO: 3489 - DNA, 16 bp, Artificial sequence
  Synthetic oligonucleotide
agtcttcattgggaat

SEQ ID NO: 3490 - DNA, 16 bp, Artificial sequence
  Synthetic oligonucleotide
cttgtaagtcttcatt

SEQ ID NO: 3491 - DNA, 16 bp, Artificial sequence
  Synthetic oligonucleotide
agtgaccttgtaagtc

SEQ ID NO: 3492 - DNA, 16 bp, Artificial sequence
  Synthetic oligonucleotide
tggttaagtgaccttg

SEQ ID NO: 3493 - DNA, 16 bp, Artificial sequence
  Synthetic oligonucleotide
gatttttggttaagtg

SEQ ID NO: 3494 - DNA, 16 bp, Artificial sequence
  Synthetic oligonucleotide
ggttgtgatttttggt

SEQ ID NO: 3495 - DNA, 16 bp, Artificial sequence
  Synthetic oligonucleotide
ccaggcggttgtgatt

SEQ ID NO: 3496 - DNA, 16 bp, Artificial sequence
  Synthetic oligonucleotide
atgggaccaggcggtt

SEQ ID NO: 3497 - DNA, 16 bp, Artificial sequence
  Synthetic oligonucleotide
aagttttcagggatgg

SEQ ID NO: 3498 - DNA, 16 bp, Artificial sequence
  Synthetic oligonucleotide
aagtagaagttttcag

SEQ ID NO: 3499 - DNA, 16 bp, Artificial sequence
  Synthetic oligonucleotide
ctaaggaagtagaagt

SEQ ID NO: 3500 - DNA, 16 bp, Artificial sequence
  Synthetic oligonucleotide
aagtagctaaggaagt

SEQ ID NO: 3501 - DNA, 16 bp, Artificial sequence
  Synthetic oligonucleotide
ggagaaaagtagctaa

SEQ ID NO: 3502 - DNA, 16 bp, Artificial sequence
  Synthetic oligonucleotide
tgtgcaggagaaaagt

SEQ ID NO: 3503 - DNA, 16 bp, Artificial sequence
  Synthetic oligonucleotide
ggtgagtgtgcaggag

SEQ ID NO: 3504 - DNA, 16 bp, Artificial sequence
  Synthetic oligonucleotide
aataaaggtgagtgtg

SEQ ID NO: 3505 - DNA, 16 bp, Artificial sequence
  Synthetic oligonucleotide
tgcaggaatagaagag

SEQ ID NO: 3506 - DNA, 16 bp, Artificial sequence
  Synthetic oligonucleotide
ttttagtgcaggaata

SEQ ID NO: 3507 - DNA, 16 bp, Artificial sequence
  Synthetic oligonucleotide
tattcacagagcttac

SEQ ID NO: 3508 - DNA, 16 bp, Artificial sequence
  Synthetic oligonucleotide
tccctgtattcacaga

SEQ ID NO: 3509 - DNA, 16 bp, Artificial sequence
  Synthetic oligonucleotide
gaaaaaatccctgtat

SEQ ID NO: 3510 - DNA, 16 bp, Artificial sequence
  Synthetic oligonucleotide
tatgaagataatggaa

SEQ ID NO: 3511 - DNA, 16 bp, Artificial sequence
  Synthetic oligonucleotide
ggagtatatacaaata

SEQ ID NO: 3512 - DNA, 16 bp, Artificial sequence
  Synthetic oligonucleotide
tattctggagtatata

SEQ ID NO: 3513 - DNA, 16 bp, Artificial sequence
  Synthetic oligonucleotide
attctatattctggag

SEQ ID NO: 3514 - DNA, 16 bp, Artificial sequence
  Synthetic oligonucleotide
catacagtattctata

SEQ ID NO: 3515 - DNA, 16 bp, Artificial sequence
  Synthetic oligonucleotide
gtgtgccatacagtat

SEQ ID NO: 3516 - DNA, 16 bp, Artificial sequence
  Synthetic oligonucleotide
agaaatgcctactgtg

SEQ ID NO: 3517 - DNA, 16 bp, Artificial sequence
  Synthetic oligonucleotide
attcaacagaaatgcc

SEQ ID NO: 3518 - DNA, 16 bp, Artificial sequence
  Synthetic oligonucleotide
gaatatgacattacat

SEQ ID NO: 3519 - DNA, 16 bp, Artificial sequence
  Synthetic oligonucleotide
ctgtgtgaatatgaca

SEQ ID NO: 3520 - DNA, 16 bp, Artificial sequence
  Synthetic oligonucleotide
acgcttctgtgtgaat

SEQ ID NO: 3521 - DNA, 16 bp, Artificial sequence
  Synthetic oligonucleotide
tagcacacgcttctgt

SEQ ID NO: 3522 - DNA, 16 bp, Artificial sequence
  Synthetic oligonucleotide
taatcatagcacacgc

SEQ ID NO: 3523 - DNA, 16 bp, Artificial sequence
  Synthetic oligonucleotide
ccaagtaataataatc

SEQ ID NO: 3524 - DNA, 16 bp, Artificial sequence
  Synthetic oligonucleotide
agtaatccaagtaata

SEQ ID NO: 3525 - DNA, 16 bp, Artificial sequence
  Synthetic oligonucleotide
atttctagtaatccaa

SEQ ID NO: 3526 - DNA, 16 bp, Artificial sequence
  Synthetic oligonucleotide
cacactatttctagta

SEQ ID NO: 3527 - DNA, 16 bp, Artificial sequence
  Synthetic oligonucleotide
atgaggcacactattt

SEQ ID NO: 3528 - DNA, 16 bp, Artificial sequence
  Synthetic oligonucleotide
ttaattatgaggcaca

SEQ ID NO: 3529 - DNA, 16 bp, Artificial sequence
  Synthetic oligonucleotide
tgacctttaattatga

SEQ ID NO: 3530 - DNA, 16 bp, Artificial sequence
  Synthetic oligonucleotide
gcaatttattgaatga

SEQ ID NO: 3531 - DNA, 16 bp, Artificial sequence
  Synthetic oligonucleotide
gggtttgcaatttatt

SEQ ID NO: 3532 - DNA, 16 bp, Artificial sequence
  Synthetic oligonucleotide
tgtgttgggtttgcaa

SEQ ID NO: 3533 - DNA, 16 bp, Artificial sequence
  Synthetic oligonucleotide
tttaagtgtgttgggt

SEQ ID NO: 3534 - DNA, 16 bp, Artificial sequence
  Synthetic oligonucleotide
gtttagcagtaacatt

SEQ ID NO: 3535 - DNA, 16 bp, Artificial sequence
  Synthetic oligonucleotide
attcagtagtttatcg

SEQ ID NO: 3536 - DNA, 16 bp, Artificial sequence
  Synthetic oligonucleotide
ctatatattcagtagt

SEQ ID NO: 3537 - DNA, 16 bp, Artificial sequence
  Synthetic oligonucleotide
gcttactttctatata

SEQ ID NO: 3538 - DNA, 16 bp, Artificial sequence
  Synthetic oligonucleotide
agtttgtttgcttact

SEQ ID NO: 3539 - DNA, 16 bp, Artificial sequence
  Synthetic oligonucleotide
ttggcaagtttgtttg

SEQ ID NO: 3540 - DNA, 16 bp, Artificial sequence
  Synthetic oligonucleotide
ggcaggttggcaagtt

SEQ ID NO: 3541 - DNA, 16 bp, Artificial sequence
  Synthetic oligonucleotide
gatgttggcaggttgg

SEQ ID NO: 3542 - DNA, 16 bp, Artificial sequence
  Synthetic oligonucleotide
aacatatctgtagatg

SEQ ID NO: 3543 - DNA, 16 bp, Artificial sequence
  Synthetic oligonucleotide
cctgtaaacatatctg

SEQ ID NO: 3544 - DNA, 16 bp, Artificial sequence
  Synthetic oligonucleotide
ttttgacctgtaaaca

SEQ ID NO: 3545 - DNA, 16 bp, Artificial sequence
  Synthetic oligonucleotide
gataatttttgacctg

SEQ ID NO: 3546 - DNA, 16 bp, Artificial sequence
  Synthetic oligonucleotide
tcttgataatttgata

SEQ ID NO: 3547 - DNA, 16 bp, Artificial sequence
  Synthetic oligonucleotide
aggctttcttgataat

SEQ ID NO: 3548 - DNA, 16 bp, Artificial sequence
  Synthetic oligonucleotide
tgaaccaggctttctt

SEQ ID NO: 3549 - DNA, 16 bp, Artificial sequence
  Synthetic oligonucleotide
gataaagacataatac

SEQ ID NO: 3550 - DNA, 16 bp, Artificial sequence
  Synthetic oligonucleotide
acctgtgataaagaca

SEQ ID NO: 3551 - DNA, 16 bp, Artificial sequence
  Synthetic oligonucleotide
cttcagacctgtgata

SEQ ID NO: 3552 - DNA, 16 bp, Artificial sequence
  Synthetic oligonucleotide
actgatcttcagacct

SEQ ID NO: 3553 - DNA, 16 bp, Artificial sequence
  Synthetic oligonucleotide
ggtcttactgatcttc

SEQ ID NO: 3554 - DNA, 16 bp, Artificial sequence
  Synthetic oligonucleotide
gttttaggtcttactg

SEQ ID NO: 3555 - DNA, 16 bp, Artificial sequence
  Synthetic oligonucleotide
gttcagattttaagtt

SEQ ID NO: 3556 - DNA, 16 bp, Artificial sequence
  Synthetic oligonucleotide
atattctgttcagatt

SEQ ID NO: 3557 - DNA, 16 bp, Artificial sequence
  Synthetic oligonucleotide
atattgtaatgtattc

SEQ ID NO: 3558 - DNA, 16 bp, Artificial sequence
  Synthetic oligonucleotide
cttagaatattgtaat

SEQ ID NO: 3559 - DNA, 16 bp, Artificial sequence
  Synthetic oligonucleotide
gctttgcttagaatat

SEQ ID NO: 3560 - DNA, 16 bp, Artificial sequence
  Synthetic oligonucleotide
gagactgctttgctta

SEQ ID NO: 3561 - DNA, 16 bp, Artificial sequence
  Synthetic oligonucleotide
aaagtagagactgctt

SEQ ID NO: 3562 - DNA, 16 bp, Artificial sequence
  Synthetic oligonucleotide
aggccaaaagtagaga

SEQ ID NO: 3563 - DNA, 16 bp, Artificial sequence
  Synthetic oligonucleotide
tcggaaaacagagcaa

SEQ ID NO: 3564 - DNA, 16 bp, Artificial sequence
  Synthetic oligonucleotide
cattggtcggaaaaca

SEQ ID NO: 3565 - DNA, 16 bp, Artificial sequence
  Synthetic oligonucleotide
agcaaggcaaaaaagc

SEQ ID NO: 3566 - DNA, 16 bp, Artificial sequence
  Synthetic oligonucleotide
gacattatttaataag

SEQ ID NO: 3567 - DNA, 16 bp, Artificial sequence
  Synthetic oligonucleotide
atcagggacattattt

SEQ ID NO: 3568 - DNA, 16 bp, Artificial sequence
  Synthetic oligonucleotide
tatttaatcagggaca

SEQ ID NO: 3569 - DNA, 16 bp, Artificial sequence
  Synthetic oligonucleotide
attacctgttctcaaa

SEQ ID NO: 3570 - DNA, 16 bp, Artificial sequence
  Synthetic oligonucleotide
gtacagattacctgtt

SEQ ID NO: 3571 - DNA, 16 bp, Artificial sequence
  Synthetic oligonucleotide
gttattcagattgtac

SEQ ID NO: 3572 - DNA, 16 bp, Artificial sequence
  Synthetic oligonucleotide
aacagtgttattcaga

SEQ ID NO: 3573 - DNA, 16 bp, Artificial sequence
  Synthetic oligonucleotide
tagataaacagtgtta

SEQ ID NO: 3574 - DNA, 16 bp, Artificial sequence
  Synthetic oligonucleotide
tgatatttagataaac

SEQ ID NO: 3575 - DNA, 16 bp, Artificial sequence
  Synthetic oligonucleotide
ggtgtttgatatttag

SEQ ID NO: 3576 - DNA, 16 bp, Artificial sequence
  Synthetic oligonucleotide
tataacggtgtttgat

SEQ ID NO: 3577 - DNA, 16 bp, Artificial sequence
  Synthetic oligonucleotide
taatgttataacggtg

SEQ ID NO: 3578 - DNA, 16 bp, Artificial sequence
  Synthetic oligonucleotide
agttcataatgttata

SEQ ID NO: 3579 - DNA, 16 bp, Artificial sequence
  Synthetic oligonucleotide
gtctttcagttcataa

SEQ ID NO: 3580 - DNA, 16 bp, Artificial sequence
  Synthetic oligonucleotide
acagtttgtctttcag

SEQ ID NO: 3581 - DNA, 16 bp, Artificial sequence
  Synthetic oligonucleotide
agaagtacagtttgtc

SEQ ID NO: 3582 - DNA, 16 bp, Artificial sequence
  Synthetic oligonucleotide
gatgtcagaagtacag

SEQ ID NO: 3583 - DNA, 16 bp, Artificial sequence
  Synthetic oligonucleotide
agtaaggatgtcagaa

SEQ ID NO: 3584 - DNA, 16 bp, Artificial sequence
  Synthetic oligonucleotide
aatctgagtaaggatg

SEQ ID NO: 3585 - DNA, 16 bp, Artificial sequence
  Synthetic oligonucleotide
gaatatacaattaggg

SEQ ID NO: 3586 - DNA, 16 bp, Artificial sequence
  Synthetic oligonucleotide
tgatactgaatataca

SEQ ID NO: 3587 - DNA, 16 bp, Artificial sequence
  Synthetic oligonucleotide
ctgagctgataaaaga

SEQ ID NO: 3588 - DNA, 16 bp, Artificial sequence
  Synthetic oligonucleotide
accatcatgttttaca

SEQ ID NO: 3589 - DNA, 16 bp, Artificial sequence
  Synthetic oligonucleotide
tgtcttaccatcatgt

SEQ ID NO: 3590 - DNA, 16 bp, Artificial sequence
  Synthetic oligonucleotide
ccaaagtgtcttacca

SEQ ID NO: 3591 - DNA, 16 bp, Artificial sequence
  Synthetic oligonucleotide
aacccaccaaagtgtc

SEQ ID NO: 3592 - DNA, 16 bp, Artificial sequence
  Synthetic oligonucleotide
gaaggaaacccaccaa

SEQ ID NO: 3593 - DNA, 16 bp, Artificial sequence
  Synthetic oligonucleotide
cttcaagaaggaaacc

SEQ ID NO: 3594 - DNA, 16 bp, Artificial sequence
  Synthetic oligonucleotide
taatagcttcaagaag

SEQ ID NO: 3595 - DNA, 16 bp, Artificial sequence
  Synthetic oligonucleotide
gggaatttgataataa

SEQ ID NO: 3596 - DNA, 16 bp, Artificial sequence
  Synthetic oligonucleotide
agaatagggaatttga

SEQ ID NO: 3597 - DNA, 16 bp, Artificial sequence
  Synthetic oligonucleotide
gtcctaagaataggga

SEQ ID NO: 3598 - DNA, 16 bp, Artificial sequence
  Synthetic oligonucleotide
gaacaagtcctaagaa

SEQ ID NO: 3599 - DNA, 16 bp, Artificial sequence
  Synthetic oligonucleotide
agtctagaacaagtcc

SEQ ID NO: 3600 - DNA, 16 bp, Artificial sequence
  Synthetic oligonucleotide
tcttttagtctagaac

SEQ ID NO: 3601 - DNA, 16 bp, Artificial sequence
  Synthetic oligonucleotide
taactatcttttagtc

SEQ ID NO: 3602 - DNA, 16 bp, Artificial sequence
  Synthetic oligonucleotide
atctcttaactatctt

SEQ ID NO: 3603 - DNA, 16 bp, Artificial sequence
  Synthetic oligonucleotide
aactgttttcttctgg

SEQ ID NO: 3604 - DNA, 16 bp, Artificial sequence
  Synthetic oligonucleotide
tcaatttcaagcaacg

SEQ ID NO: 3605 - DNA, 16 bp, Artificial sequence
  Synthetic oligonucleotide
cttaattgtgaacatt

SEQ ID NO: 3606 - DNA, 16 bp, Artificial sequence
  Synthetic oligonucleotide
agcttaattgtgaaca

SEQ ID NO: 3607 - DNA, 16 bp, Artificial sequence
  Synthetic oligonucleotide
ggagcttaattgtgaa

SEQ ID NO: 3608 - DNA, 16 bp, Artificial sequence
  Synthetic oligonucleotide
aaggagcttaattgtg

SEQ ID NO: 3609 - DNA, 16 bp, Artificial sequence
  Synthetic oligonucleotide
agaaggagcttaattg

SEQ ID NO: 3610 - DNA, 16 bp, Artificial sequence
  Synthetic oligonucleotide
aaagaaggagcttaat

SEQ ID NO: 3611 - DNA, 16 bp, Artificial sequence
  Synthetic oligonucleotide
ctagaggaacaataaa

SEQ ID NO: 3612 - DNA, 16 bp, Artificial sequence
  Synthetic oligonucleotide
taactagaggaacaat

SEQ ID NO: 3613 - DNA, 16 bp, Artificial sequence
  Synthetic oligonucleotide
aataactagaggaaca

SEQ ID NO: 3614 - DNA, 16 bp, Artificial sequence
  Synthetic oligonucleotide
ggaaataactagagga

SEQ ID NO: 3615 - DNA, 16 bp, Artificial sequence
  Synthetic oligonucleotide
gaggaaataactagag

SEQ ID NO: 3616 - DNA, 16 bp, Artificial sequence
  Synthetic oligonucleotide
tggaggaaataactag

SEQ ID NO: 3617 - DNA, 16 bp, Artificial sequence
  Synthetic oligonucleotide
tctggaggaaataact

SEQ ID NO: 3618 - DNA, 16 bp, Artificial sequence
  Synthetic oligonucleotide
caattctggaggaaat

SEQ ID NO: 3619 - DNA, 16 bp, Artificial sequence
  Synthetic oligonucleotide
atcaattctggaggaa

SEQ ID NO: 3620 - DNA, 16 bp, Artificial sequence
  Synthetic oligonucleotide
tgatcaattctggagg

SEQ ID NO: 3621 - DNA, 16 bp, Artificial sequence
  Synthetic oligonucleotide
ttgtcttgatcaattc

SEQ ID NO: 3622 - DNA, 16 bp, Artificial sequence
  Synthetic oligonucleotide
aattgtcttgatcaat

SEQ ID NO: 3623 - DNA, 16 bp, Artificial sequence
  Synthetic oligonucleotide
tgaattgtcttgatca

SEQ ID NO: 3624 - DNA, 16 bp, Artificial sequence
  Synthetic oligonucleotide
gatgaattgtcttgat

SEQ ID NO: 3625 - DNA, 16 bp, Artificial sequence
  Synthetic oligonucleotide
atgatgaattgtcttg

SEQ ID NO: 3626 - DNA, 16 bp, Artificial sequence
  Synthetic oligonucleotide
caaatgatgaattgtc

SEQ ID NO: 3627 - DNA, 16 bp, Artificial sequence
  Synthetic oligonucleotide
atcaaatgatgaattg

SEQ ID NO: 3628 - DNA, 16 bp, Artificial sequence
  Synthetic oligonucleotide
gatagagaatcaaatg

SEQ ID NO: 3629 - DNA, 16 bp, Artificial sequence
  Synthetic oligonucleotide
tggagatagagaatca

SEQ ID NO: 3630 - DNA, 16 bp, Artificial sequence
  Synthetic oligonucleotide
tctggagatagagaat

SEQ ID NO: 3631 - DNA, 16 bp, Artificial sequence
  Synthetic oligonucleotide
tttggctctggagata

SEQ ID NO: 3632 - DNA, 16 bp, Artificial sequence
  Synthetic oligonucleotide
attttggctctggaga

SEQ ID NO: 3633 - DNA, 16 bp, Artificial sequence
  Synthetic oligonucleotide
atcttgattttggctc

SEQ ID NO: 3634 - DNA, 16 bp, Artificial sequence
  Synthetic oligonucleotide
gcaaatcttgattttg

SEQ ID NO: 3635 - DNA, 16 bp, Artificial sequence
  Synthetic oligonucleotide
tagcaaatcttgattt

SEQ ID NO: 3636 - DNA, 16 bp, Artificial sequence
  Synthetic oligonucleotide
catagcaaatcttgat

SEQ ID NO: 3637 - DNA, 16 bp, Artificial sequence
  Synthetic oligonucleotide
aacatagcaaatcttg

SEQ ID NO: 3638 - DNA, 16 bp, Artificial sequence
  Synthetic oligonucleotide
ctaacatagcaaatct

SEQ ID NO: 3639 - DNA, 16 bp, Artificial sequence
  Synthetic oligonucleotide
gtctaacatagcaaat

SEQ ID NO: 3640 - DNA, 16 bp, Artificial sequence
  Synthetic oligonucleotide
taaaatttttacatcg

SEQ ID NO: 3641 - DNA, 16 bp, Artificial sequence
  Synthetic oligonucleotide
ggctaaaatttttaca

SEQ ID NO: 3642 - DNA, 16 bp, Artificial sequence
  Synthetic oligonucleotide
ccattggctaaaattt

SEQ ID NO: 3643 - DNA, 16 bp, Artificial sequence
  Synthetic oligonucleotide
ggccattggctaaaat

SEQ ID NO: 3644 - DNA, 16 bp, Artificial sequence
  Synthetic oligonucleotide
gaggccattggctaaa

SEQ ID NO: 3645 - DNA, 16 bp, Artificial sequence
  Synthetic oligonucleotide
aggaggccattggcta

SEQ ID NO: 3646 - DNA, 16 bp, Artificial sequence
  Synthetic oligonucleotide
gaaggaggccattggc

SEQ ID NO: 3647 - DNA, 16 bp, Artificial sequence
  Synthetic oligonucleotide
ctgaaggaggccattg

SEQ ID NO: 3648 - DNA, 16 bp, Artificial sequence
  Synthetic oligonucleotide
aactgaaggaggccat

SEQ ID NO: 3649 - DNA, 16 bp, Artificial sequence
  Synthetic oligonucleotide
ccaactgaaggaggcc

SEQ ID NO: 3650 - DNA, 16 bp, Artificial sequence
  Synthetic oligonucleotide
tcccaactgaaggagg

SEQ ID NO: 3651 - DNA, 16 bp, Artificial sequence
  Synthetic oligonucleotide
tgtcccaactgaagga

SEQ ID NO: 3652 - DNA, 16 bp, Artificial sequence
  Synthetic oligonucleotide
catgtcccaactgaag

SEQ ID NO: 3653 - DNA, 16 bp, Artificial sequence
  Synthetic oligonucleotide
accatgtcccaactga

SEQ ID NO: 3654 - DNA, 16 bp, Artificial sequence
  Synthetic oligonucleotide
agaccatgtcccaact

SEQ ID NO: 3655 - DNA, 16 bp, Artificial sequence
  Synthetic oligonucleotide
taagaccatgtcccaa

SEQ ID NO: 3656 - DNA, 16 bp, Artificial sequence
  Synthetic oligonucleotide
tttaagaccatgtccc

SEQ ID NO: 3657 - DNA, 16 bp, Artificial sequence
  Synthetic oligonucleotide
tctttaagaccatgtc

SEQ ID NO: 3658 - DNA, 16 bp, Artificial sequence
  Synthetic oligonucleotide
agtctttaagaccatg

SEQ ID NO: 3659 - DNA, 16 bp, Artificial sequence
  Synthetic oligonucleotide
aaagtctttaagacca

SEQ ID NO: 3660 - DNA, 16 bp, Artificial sequence
  Synthetic oligonucleotide
acaaagtctttaagac

SEQ ID NO: 3661 - DNA, 16 bp, Artificial sequence
  Synthetic oligonucleotide
ggacaaagtctttaag

SEQ ID NO: 3662 - DNA, 16 bp, Artificial sequence
  Synthetic oligonucleotide
atggacaaagtcttta

SEQ ID NO: 3663 - DNA, 16 bp, Artificial sequence
  Synthetic oligonucleotide
ttatggacaaagtctt

SEQ ID NO: 3664 - DNA, 16 bp, Artificial sequence
  Synthetic oligonucleotide
tcttatggacaaagtc

SEQ ID NO: 3665 - DNA, 16 bp, Artificial sequence
  Synthetic oligonucleotide
cgtcttatggacaaag

SEQ ID NO: 3666 - DNA, 16 bp, Artificial sequence
  Synthetic oligonucleotide
ttaatttggcccttcg

SEQ ID NO: 3667 - DNA, 16 bp, Artificial sequence
  Synthetic oligonucleotide
cattaatttggccctt

SEQ ID NO: 3668 - DNA, 16 bp, Artificial sequence
  Synthetic oligonucleotide
gtcattaatttggccc

SEQ ID NO: 3669 - DNA, 16 bp, Artificial sequence
  Synthetic oligonucleotide
atgtcattaatttggc

SEQ ID NO: 3670 - DNA, 16 bp, Artificial sequence
  Synthetic oligonucleotide
tatgttgagtttttga

SEQ ID NO: 3671 - DNA, 16 bp, Artificial sequence
  Synthetic oligonucleotide
tcaaatatgttgagtt

SEQ ID NO: 3672 - DNA, 16 bp, Artificial sequence
  Synthetic oligonucleotide
gatcaaatatgttgag

SEQ ID NO: 3673 - DNA, 16 bp, Artificial sequence
  Synthetic oligonucleotide
gtacaattaccagtcc

SEQ ID NO: 3674 - DNA, 16 bp, Artificial sequence
  Synthetic oligonucleotide
ctgtacaattaccagt

SEQ ID NO: 3675 - DNA, 16 bp, Artificial sequence
  Synthetic oligonucleotide
aactgtacaattacca

SEQ ID NO: 3676 - DNA, 16 bp, Artificial sequence
  Synthetic oligonucleotide
agaactgtacaattac

SEQ ID NO: 3677 - DNA, 16 bp, Artificial sequence
  Synthetic oligonucleotide
taagaactgtacaatt

SEQ ID NO: 3678 - DNA, 16 bp, Artificial sequence
  Synthetic oligonucleotide
catttaagaactgtac

SEQ ID NO: 3679 - DNA, 16 bp, Artificial sequence
  Synthetic oligonucleotide
tactacaacatttaag

SEQ ID NO: 3680 - DNA, 16 bp, Artificial sequence
  Synthetic oligonucleotide
ttaatactacaacatt

SEQ ID NO: 3681 - DNA, 16 bp, Artificial sequence
  Synthetic oligonucleotide
ttgaaattaatactac

SEQ ID NO: 3682 - DNA, 16 bp, Artificial sequence
  Synthetic oligonucleotide
gttttgaaattaatac

SEQ ID NO: 3683 - DNA, 16 bp, Artificial sequence
  Synthetic oligonucleotide
cgatttttagttttga

SEQ ID NO: 3684 - DNA, 16 bp, Artificial sequence
  Synthetic oligonucleotide
gacgatttttagtttt

SEQ ID NO: 3685 - DNA, 16 bp, Artificial sequence
  Synthetic oligonucleotide
ctgacgatttttagtt

SEQ ID NO: 3686 - DNA, 16 bp, Artificial sequence
  Synthetic oligonucleotide
tgctgacgatttttag

SEQ ID NO: 3687 - DNA, 16 bp, Artificial sequence
  Synthetic oligonucleotide
tgtgctgacgattttt

SEQ ID NO: 3688 - DNA, 16 bp, Artificial sequence
  Synthetic oligonucleotide
tctgtgctgacgattt

SEQ ID NO: 3689 - DNA, 16 bp, Artificial sequence
  Synthetic oligonucleotide
tacacatactctgtgc

SEQ ID NO: 3690 - DNA, 16 bp, Artificial sequence
  Synthetic oligonucleotide
tttacacatactctgt

SEQ ID NO: 3691 - DNA, 16 bp, Artificial sequence
  Synthetic oligonucleotide
gatttttacacatact

SEQ ID NO: 3692 - DNA, 16 bp, Artificial sequence
  Synthetic oligonucleotide
gaagcatcagtttaaa

SEQ ID NO: 3693 - DNA, 16 bp, Artificial sequence
  Synthetic oligonucleotide
atgaagcatcagttta

SEQ ID NO: 3694 - DNA, 16 bp, Artificial sequence
  Synthetic oligonucleotide
ttgtagcaaaatgaag

SEQ ID NO: 3695 - DNA, 16 bp, Artificial sequence
  Synthetic oligonucleotide
catttactccaaatta

SEQ ID NO: 3696 - DNA, 16 bp, Artificial sequence
  Synthetic oligonucleotide
cattaggtttcataaa

SEQ ID NO: 3697 - DNA, 16 bp, Artificial sequence
  Synthetic oligonucleotide
ttcattaggtttcata

SEQ ID NO: 3698 - DNA, 16 bp, Artificial sequence
  Synthetic oligonucleotide
gcttcattaggtttca

SEQ ID NO: 3699 - DNA, 16 bp, Artificial sequence
  Synthetic oligonucleotide
ctgcttcattaggttt

SEQ ID NO: 3700 - DNA, 16 bp, Artificial sequence
  Synthetic oligonucleotide
ttctgcttcattaggt

SEQ ID NO: 3701 - DNA, 16 bp, Artificial sequence
  Synthetic oligonucleotide
aattctgcttcattag

SEQ ID NO: 3702 - DNA, 16 bp, Artificial sequence
  Synthetic oligonucleotide
cagtatttaattctgc

SEQ ID NO: 3703 - DNA, 16 bp, Artificial sequence
  Synthetic oligonucleotide
gaacttattttaatac

SEQ ID NO: 3704 - DNA, 16 bp, Artificial sequence
  Synthetic oligonucleotide
gcgaacttattttaat

SEQ ID NO: 3705 - DNA, 16 bp, Artificial sequence
  Synthetic oligonucleotide
cagcgaacttatttta

SEQ ID NO: 3706 - DNA, 16 bp, Artificial sequence
  Synthetic oligonucleotide
gacagcgaacttattt

SEQ ID NO: 3707 - DNA, 16 bp, Artificial sequence
  Synthetic oligonucleotide
aagacagcgaacttat

SEQ ID NO: 3708 - DNA, 16 bp, Artificial sequence
  Synthetic oligonucleotide
tttaaagacagcgaac

SEQ ID NO: 3709 - DNA, 16 bp, Artificial sequence
  Synthetic oligonucleotide
gtcatctccatttgtt

SEQ ID NO: 3710 - DNA, 16 bp, Artificial sequence
  Synthetic oligonucleotide
tagtcatctccatttg

SEQ ID NO: 3711 - DNA, 16 bp, Artificial sequence
  Synthetic oligonucleotide
acttagtagtcatctc

SEQ ID NO: 3712 - DNA, 16 bp, Artificial sequence
  Synthetic oligonucleotide
tgacttagtagtcatc

SEQ ID NO: 3713 - DNA, 16 bp, Artificial sequence
  Synthetic oligonucleotide
tgtgacttagtagtca

SEQ ID NO: 3714 - DNA, 16 bp, Artificial sequence
  Synthetic oligonucleotide
aatgtgacttagtagt

SEQ ID NO: 3715 - DNA, 16 bp, Artificial sequence
  Synthetic oligonucleotide
tcaatgtgacttagta

SEQ ID NO: 3716 - DNA, 16 bp, Artificial sequence
  Synthetic oligonucleotide
agtcaatgtgacttag

SEQ ID NO: 3717 - DNA, 16 bp, Artificial sequence
  Synthetic oligonucleotide
aaagtcaatgtgactt

SEQ ID NO: 3718 - DNA, 16 bp, Artificial sequence
  Synthetic oligonucleotide
ttaaagtcaatgtgac

SEQ ID NO: 3719 - DNA, 16 bp, Artificial sequence
  Synthetic oligonucleotide
tgttaaagtcaatgtg

SEQ ID NO: 3720 - DNA, 16 bp, Artificial sequence
  Synthetic oligonucleotide
catgttaaagtcaatg

SEQ ID NO: 3721 - DNA, 16 bp, Artificial sequence
  Synthetic oligonucleotide
ctcatgttaaagtcaa

SEQ ID NO: 3722 - DNA, 16 bp, Artificial sequence
  Synthetic oligonucleotide
acctcatgttaaagtc

SEQ ID NO: 3723 - DNA, 16 bp, Artificial sequence
  Synthetic oligonucleotide
atacctcatgttaaag

SEQ ID NO: 3724 - DNA, 16 bp, Artificial sequence
  Synthetic oligonucleotide
tgatacctcatgttaa

SEQ ID NO: 3725 - DNA, 16 bp, Artificial sequence
  Synthetic oligonucleotide
agtgatacctcatgtt

SEQ ID NO: 3726 - DNA, 16 bp, Artificial sequence
  Synthetic oligonucleotide
atagtgatacctcatg

SEQ ID NO: 3727 - DNA, 16 bp, Artificial sequence
  Synthetic oligonucleotide
gtatagtgatacctca

SEQ ID NO: 3728 - DNA, 16 bp, Artificial sequence
  Synthetic oligonucleotide
aggtatagtgatacct

SEQ ID NO: 3729 - DNA, 16 bp, Artificial sequence
  Synthetic oligonucleotide
taaggtatagtgatac

SEQ ID NO: 3730 - DNA, 16 bp, Artificial sequence
  Synthetic oligonucleotide
aataaggtatagtgat

SEQ ID NO: 3731 - DNA, 16 bp, Artificial sequence
  Synthetic oligonucleotide
gtaaacttattgataa

SEQ ID NO: 3732 - DNA, 16 bp, Artificial sequence
  Synthetic oligonucleotide
ggcatagtaaacttat

SEQ ID NO: 3733 - DNA, 16 bp, Artificial sequence
  Synthetic oligonucleotide
aattttggcatagtaa

SEQ ID NO: 3734 - DNA, 16 bp, Artificial sequence
  Synthetic oligonucleotide
ggcaattaatgaattt

SEQ ID NO: 3735 - DNA, 16 bp, Artificial sequence
  Synthetic oligonucleotide
gtgaaaggcaattaat

SEQ ID NO: 3736 - DNA, 16 bp, Artificial sequence
  Synthetic oligonucleotide
agttaagtgaaaggca

SEQ ID NO: 3737 - DNA, 16 bp, Artificial sequence
  Synthetic oligonucleotide
cccaaaagttaagtga

SEQ ID NO: 3738 - DNA, 16 bp, Artificial sequence
  Synthetic oligonucleotide
tatggtcccaaaagtt

SEQ ID NO: 3739 - DNA, 16 bp, Artificial sequence
  Synthetic oligonucleotide
atttattatggtccca

SEQ ID NO: 3740 - DNA, 16 bp, Artificial sequence
  Synthetic oligonucleotide
gttatggcaatacatt

SEQ ID NO: 3741 - DNA, 16 bp, Artificial sequence
  Synthetic oligonucleotide
attaatgttatggcaa

SEQ ID NO: 3742 - DNA, 16 bp, Artificial sequence
  Synthetic oligonucleotide
gtagtttattaatgtt

SEQ ID NO: 3743 - DNA, 16 bp, Artificial sequence
  Synthetic oligonucleotide
tgtaaggtagtttatt

SEQ ID NO: 3744 - DNA, 16 bp, Artificial sequence
  Synthetic oligonucleotide
tggttttgtaaggtag

SEQ ID NO: 3745 - DNA, 16 bp, Artificial sequence
  Synthetic oligonucleotide
aattggtggttttgta

SEQ ID NO: 3746 - DNA, 16 bp, Artificial sequence
  Synthetic oligonucleotide
gattttaattggtggt

SEQ ID NO: 3747 - DNA, 16 bp, Artificial sequence
  Synthetic oligonucleotide
gatgtaaataacactt

SEQ ID NO: 3748 - DNA, 16 bp, Artificial sequence
  Synthetic oligonucleotide
ttgacagatgtaaata

SEQ ID NO: 3749 - DNA, 16 bp, Artificial sequence
  Synthetic oligonucleotide
tttatgttgacagatg

SEQ ID NO: 3750 - DNA, 16 bp, Artificial sequence
  Synthetic oligonucleotide
agtagatttatgttga

SEQ ID NO: 3751 - DNA, 16 bp, Artificial sequence
  Synthetic oligonucleotide
cctgaatataatgaat

SEQ ID NO: 3752 - DNA, 16 bp, Artificial sequence
  Synthetic oligonucleotide
ggactacctgaatata

SEQ ID NO: 3753 - DNA, 16 bp, Artificial sequence
  Synthetic oligonucleotide
accatcaagcctccca

SEQ ID NO: 3754 - DNA, 16 bp, Artificial sequence
  Synthetic oligonucleotide
ccccttaccatcaagc

SEQ ID NO: 3755 - DNA, 16 bp, Artificial sequence
  Synthetic oligonucleotide
tgtagtccccttacca

SEQ ID NO: 3756 - DNA, 16 bp, Artificial sequence
  Synthetic oligonucleotide
attgaatgtagtcccc

SEQ ID NO: 3757 - DNA, 16 bp, Artificial sequence
  Synthetic oligonucleotide
gattagcaagtgaatg

SEQ ID NO: 3758 - DNA, 16 bp, Artificial sequence
  Synthetic oligonucleotide
tttgtagattagcaag

SEQ ID NO: 3759 - DNA, 16 bp, Artificial sequence
  Synthetic oligonucleotide
aagaggttctcagtaa

SEQ ID NO: 3760 - DNA, 16 bp, Artificial sequence
  Synthetic oligonucleotide
gtccataagaggttct

SEQ ID NO: 3761 - DNA, 16 bp, Artificial sequence
  Synthetic oligonucleotide
tacctggtccataaga

SEQ ID NO: 3762 - DNA, 16 bp, Artificial sequence
  Synthetic oligonucleotide
tcctaatacctggtcc

SEQ ID NO: 3763 - DNA, 16 bp, Artificial sequence
  Synthetic oligonucleotide
tacttttcctaatacc

SEQ ID NO: 3764 - DNA, 16 bp, Artificial sequence
  Synthetic oligonucleotide
cgttactacttttcct

SEQ ID NO: 3765 - DNA, 16 bp, Artificial sequence
  Synthetic oligonucleotide
ctgagactgcttctcg

SEQ ID NO: 3766 - DNA, 16 bp, Artificial sequence
  Synthetic oligonucleotide
tgaaggctgagactgc

SEQ ID NO: 3767 - DNA, 16 bp, Artificial sequence
  Synthetic oligonucleotide
taaattatatgaaggc

SEQ ID NO: 3768 - DNA, 16 bp, Artificial sequence
  Synthetic oligonucleotide
gtaattgtttgataat

SEQ ID NO: 3769 - DNA, 16 bp, Artificial sequence
  Synthetic oligonucleotide
tactaacaaatgtgta

SEQ ID NO: 3770 - DNA, 16 bp, Artificial sequence
  Synthetic oligonucleotide
gtaatttactaacaaa

SEQ ID NO: 3771 - DNA, 16 bp, Artificial sequence
  Synthetic oligonucleotide
ataagtgtaatttact

SEQ ID NO: 3772 - DNA, 16 bp, Artificial sequence
  Synthetic oligonucleotide
gttgtaataagtgtaa

SEQ ID NO: 3773 - DNA, 16 bp, Artificial sequence
  Synthetic oligonucleotide
gtgataaatataattc

SEQ ID NO: 3774 - DNA, 16 bp, Artificial sequence
  Synthetic oligonucleotide
catgtaattgtgataa

SEQ ID NO: 3775 - DNA, 16 bp, Artificial sequence
  Synthetic oligonucleotide
gtatatttaagaacag

SEQ ID NO: 3776 - DNA, 16 bp, Artificial sequence
  Synthetic oligonucleotide
ttgtgataagtatatt

SEQ ID NO: 3777 - DNA, 16 bp, Artificial sequence
  Synthetic oligonucleotide
tggaattaaattgtga

SEQ ID NO: 3778 - DNA, 16 bp, Artificial sequence
  Synthetic oligonucleotide
aagccgtggaattaaa

SEQ ID NO: 3779 - DNA, 16 bp, Artificial sequence
  Synthetic oligonucleotide
cattgtaagccgtgga

SEQ ID NO: 3780 - DNA, 16 bp, Artificial sequence
  Synthetic oligonucleotide
tatgatcattgtaagc

SEQ ID NO: 3781 - DNA, 16 bp, Artificial sequence
  Synthetic oligonucleotide
tatagttatgatcatt

SEQ ID NO: 3782 - DNA, 16 bp, Artificial sequence
  Synthetic oligonucleotide
gacataacatttaatc

SEQ ID NO: 3783 - DNA, 16 bp, Artificial sequence
  Synthetic oligonucleotide
acttatgacataacat

SEQ ID NO: 3784 - DNA, 16 bp, Artificial sequence
  Synthetic oligonucleotide
gttactacttatgaca

SEQ ID NO: 3785 - DNA, 16 bp, Artificial sequence
  Synthetic oligonucleotide
gtaacagttactactt

SEQ ID NO: 3786 - DNA, 16 bp, Artificial sequence
  Synthetic oligonucleotide
gcttatttgtaacagt

SEQ ID NO: 3787 - DNA, 16 bp, Artificial sequence
  Synthetic oligonucleotide
ttcacagcttatttgt

SEQ ID NO: 3788 - DNA, 16 bp, Artificial sequence
  Synthetic oligonucleotide
gttcttttcacagctt

SEQ ID NO: 3789 - DNA, 16 bp, Artificial sequence
  Synthetic oligonucleotide
ggagtggttcttttca

SEQ ID NO: 3790 - DNA, 16 bp, Artificial sequence
  Synthetic oligonucleotide
atgctaggagtggttc

SEQ ID NO: 3791 - DNA, 16 bp, Artificial sequence
  Synthetic oligonucleotide
tgactaatgctaggag

SEQ ID NO: 3792 - DNA, 16 bp, Artificial sequence
  Synthetic oligonucleotide
atagagtgactaatgc

SEQ ID NO: 3793 - DNA, 16 bp, Artificial sequence
  Synthetic oligonucleotide
gagagaatagagtgac

SEQ ID NO: 3794 - DNA, 16 bp, Artificial sequence
  Synthetic oligonucleotide
attgatatgtaaaacg

SEQ ID NO: 3795 - DNA, 16 bp, Artificial sequence
  Synthetic oligonucleotide
caattaattgatatgt

SEQ ID NO: 3796 - DNA, 16 bp, Artificial sequence
  Synthetic oligonucleotide
ccttttaacttccaat

SEQ ID NO: 3797 - DNA, 16 bp, Artificial sequence
  Synthetic oligonucleotide
cctggtccttttaact

SEQ ID NO: 3798 - DNA, 16 bp, Artificial sequence
  Synthetic oligonucleotide
gagtttcctggtcctt

SEQ ID NO: 3799 - DNA, 16 bp, Artificial sequence
  Synthetic oligonucleotide
atgtctgagtttcctg

SEQ ID NO: 3800 - DNA, 16 bp, Artificial sequence
  Synthetic oligonucleotide
tactgtatgtctgagt

SEQ ID NO: 3801 - DNA, 16 bp, Artificial sequence
  Synthetic oligonucleotide
ccatacattctatata

SEQ ID NO: 3802 - DNA, 16 bp, Artificial sequence
  Synthetic oligonucleotide
tataagccatacattc

SEQ ID NO: 3803 - DNA, 16 bp, Artificial sequence
  Synthetic oligonucleotide
attcattataagccat

SEQ ID NO: 3804 - DNA, 16 bp, Artificial sequence
  Synthetic oligonucleotide
cattgagttaactaat

SEQ ID NO: 3805 - DNA, 16 bp, Artificial sequence
  Synthetic oligonucleotide
aatttgcattgagtta

SEQ ID NO: 3806 - DNA, 16 bp, Artificial sequence
  Synthetic oligonucleotide
tgaagttacttctggg

SEQ ID NO: 3807 - DNA, 16 bp, Artificial sequence
  Synthetic oligonucleotide
agtgaagttacttctg

SEQ ID NO: 3808 - DNA, 16 bp, Artificial sequence
  Synthetic oligonucleotide
taagtgaagttacttc

SEQ ID NO: 3809 - DNA, 16 bp, Artificial sequence
  Synthetic oligonucleotide
gttttaagtgaagtta

SEQ ID NO: 3810 - DNA, 16 bp, Artificial sequence
  Synthetic oligonucleotide
aagttttaagtgaagt

SEQ ID NO: 3811 - DNA, 16 bp, Artificial sequence
  Synthetic oligonucleotide
gtttttctacaaaagt

SEQ ID NO: 3812 - DNA, 16 bp, Artificial sequence
  Synthetic oligonucleotide
atgctattatcttgtt

SEQ ID NO: 3813 - DNA, 16 bp, Artificial sequence
  Synthetic oligonucleotide
tgatgctattatcttg

SEQ ID NO: 3814 - DNA, 16 bp, Artificial sequence
  Synthetic oligonucleotide
tttgatgctattatct

SEQ ID NO: 3815 - DNA, 16 bp, Artificial sequence
  Synthetic oligonucleotide
gtctttgatgctatta

SEQ ID NO: 3816 - DNA, 16 bp, Artificial sequence
  Synthetic oligonucleotide
aggtctttgatgctat

SEQ ID NO: 3817 - DNA, 16 bp, Artificial sequence
  Synthetic oligonucleotide
gaaggtctttgatgct

SEQ ID NO: 3818 - DNA, 16 bp, Artificial sequence
  Synthetic oligonucleotide
gagaaggtctttgatg

SEQ ID NO: 3819 - DNA, 16 bp, Artificial sequence
  Synthetic oligonucleotide
tggagaaggtctttga

SEQ ID NO: 3820 - DNA, 16 bp, Artificial sequence
  Synthetic oligonucleotide
tctggagaaggtcttt

SEQ ID NO: 3821 - DNA, 16 bp, Artificial sequence
  Synthetic oligonucleotide
ggtctggagaaggtct

SEQ ID NO: 3822 - DNA, 16 bp, Artificial sequence
  Synthetic oligonucleotide
acggtctggagaaggt

SEQ ID NO: 3823 - DNA, 16 bp, Artificial sequence
  Synthetic oligonucleotide
ccacggtctggagaag

SEQ ID NO: 3824 - DNA, 16 bp, Artificial sequence
  Synthetic oligonucleotide
ttccacggtctggaga

SEQ ID NO: 3825 - DNA, 16 bp, Artificial sequence
  Synthetic oligonucleotide
tcttccacggtctgga

SEQ ID NO: 3826 - DNA, 16 bp, Artificial sequence
  Synthetic oligonucleotide
ggtcttccacggtctg

SEQ ID NO: 3827 - DNA, 16 bp, Artificial sequence
  Synthetic oligonucleotide
ttggtcttccacggtc

SEQ ID NO: 3828 - DNA, 16 bp, Artificial sequence
  Synthetic oligonucleotide
tattggtcttccacgg

SEQ ID NO: 3829 - DNA, 16 bp, Artificial sequence
  Synthetic oligonucleotide
tatattggtcttccac

SEQ ID NO: 3830 - DNA, 16 bp, Artificial sequence
  Synthetic oligonucleotide
tttatattggtcttcc

SEQ ID NO: 3831 - DNA, 16 bp, Artificial sequence
  Synthetic oligonucleotide
tgtttatattggtctt

SEQ ID NO: 3832 - DNA, 16 bp, Artificial sequence
  Synthetic oligonucleotide
attgtttatattggtc

SEQ ID NO: 3833 - DNA, 16 bp, Artificial sequence
  Synthetic oligonucleotide
taattgtttatattgg

SEQ ID NO: 3834 - DNA, 16 bp, Artificial sequence
  Synthetic oligonucleotide
ggtttaattgtttata

SEQ ID NO: 3835 - DNA, 16 bp, Artificial sequence
  Synthetic oligonucleotide
gttggtttaattgttt

SEQ ID NO: 3836 - DNA, 16 bp, Artificial sequence
  Synthetic oligonucleotide
ctgttggtttaattgt

SEQ ID NO: 3837 - DNA, 16 bp, Artificial sequence
  Synthetic oligonucleotide
tgctgttggtttaatt

SEQ ID NO: 3838 - DNA, 16 bp, Artificial sequence
  Synthetic oligonucleotide
tatgctgttggtttaa

SEQ ID NO: 3839 - DNA, 16 bp, Artificial sequence
  Synthetic oligonucleotide
actatgctgttggttt

SEQ ID NO: 3840 - DNA, 16 bp, Artificial sequence
  Synthetic oligonucleotide
tgactatgctgttggt

SEQ ID NO: 3841 - DNA, 16 bp, Artificial sequence
  Synthetic oligonucleotide
tttgactatgctgttg

SEQ ID NO: 3842 - DNA, 16 bp, Artificial sequence
  Synthetic oligonucleotide
tatttgactatgctgt

SEQ ID NO: 3843 - DNA, 16 bp, Artificial sequence
  Synthetic oligonucleotide
tttatttgactatgct

SEQ ID NO: 3844 - DNA, 16 bp, Artificial sequence
  Synthetic oligonucleotide
cttttatttgactatg

SEQ ID NO: 3845 - DNA, 16 bp, Artificial sequence
  Synthetic oligonucleotide
gagctgattttctatt

SEQ ID NO: 3846 - DNA, 16 bp, Artificial sequence
  Synthetic oligonucleotide
ctgagctgattttcta

SEQ ID NO: 3847 - DNA, 16 bp, Artificial sequence
  Synthetic oligonucleotide
ttctgagctgattttc

SEQ ID NO: 3848 - DNA, 16 bp, Artificial sequence
  Synthetic oligonucleotide
ccttctgagctgattt

SEQ ID NO: 3849 - DNA, 16 bp, Artificial sequence
  Synthetic oligonucleotide
gtccttctgagctgat

SEQ ID NO: 3850 - DNA, 16 bp, Artificial sequence
  Synthetic oligonucleotide
tagtccttctgagctg

SEQ ID NO: 3851 - DNA, 16 bp, Artificial sequence
  Synthetic oligonucleotide
actagtccttctgagc

SEQ ID NO: 3852 - DNA, 16 bp, Artificial sequence
  Synthetic oligonucleotide
atactagtccttctga

SEQ ID NO: 3853 - DNA, 16 bp, Artificial sequence
  Synthetic oligonucleotide
gaatactagtccttct

SEQ ID NO: 3854 - DNA, 16 bp, Artificial sequence
  Synthetic oligonucleotide
ttgaatactagtcctt

SEQ ID NO: 3855 - DNA, 16 bp, Artificial sequence
  Synthetic oligonucleotide
tcttgaatactagtcc

SEQ ID NO: 3856 - DNA, 16 bp, Artificial sequence
  Synthetic oligonucleotide
gttcttgaatactagt

SEQ ID NO: 3857 - DNA, 16 bp, Artificial sequence
  Synthetic oligonucleotide
gggttcttgaatacta

SEQ ID NO: 3858 - DNA, 16 bp, Artificial sequence
  Synthetic oligonucleotide
gtgggttcttgaatac

SEQ ID NO: 3859 - DNA, 16 bp, Artificial sequence
  Synthetic oligonucleotide
ctgtgggttcttgaat

SEQ ID NO: 3860 - DNA, 16 bp, Artificial sequence
  Synthetic oligonucleotide
ttctgtgggttcttga

SEQ ID NO: 3861 - DNA, 16 bp, Artificial sequence
  Synthetic oligonucleotide
aaatttctgtgggttc

SEQ ID NO: 3862 - DNA, 16 bp, Artificial sequence
  Synthetic oligonucleotide
agaaatttctgtgggt

SEQ ID NO: 3863 - DNA, 16 bp, Artificial sequence
  Synthetic oligonucleotide
tagagaaatttctgtg

SEQ ID NO: 3864 - DNA, 16 bp, Artificial sequence
  Synthetic oligonucleotide
gatagagaaatttctg

SEQ ID NO: 3865 - DNA, 16 bp, Artificial sequence
  Synthetic oligonucleotide
gcttggaagatagaga

SEQ ID NO: 3866 - DNA, 16 bp, Artificial sequence
  Synthetic oligonucleotide
tggcttggaagataga

SEQ ID NO: 3867 - DNA, 16 bp, Artificial sequence
  Synthetic oligonucleotide
cttggcttggaagata

SEQ ID NO: 3868 - DNA, 16 bp, Artificial sequence
  Synthetic oligonucleotide
ctcttggcttggaaga

SEQ ID NO: 3869 - DNA, 16 bp, Artificial sequence
  Synthetic oligonucleotide
tgctcttggcttggaa

SEQ ID NO: 3870 - DNA, 16 bp, Artificial sequence
  Synthetic oligonucleotide
ttggtgctcttggctt

SEQ ID NO: 3871 - DNA, 16 bp, Artificial sequence
  Synthetic oligonucleotide
tcttggtgctcttggc

SEQ ID NO: 3872 - DNA, 16 bp, Artificial sequence
  Synthetic oligonucleotide
gttcttggtgctcttg

SEQ ID NO: 3873 - DNA, 16 bp, Artificial sequence
  Synthetic oligonucleotide
tagttcttggtgctct

SEQ ID NO: 3874 - DNA, 16 bp, Artificial sequence
  Synthetic oligonucleotide
agtagttcttggtgct

SEQ ID NO: 3875 - DNA, 16 bp, Artificial sequence
  Synthetic oligonucleotide
ggagtagttcttggtg

SEQ ID NO: 3876 - DNA, 16 bp, Artificial sequence
  Synthetic oligonucleotide
agggagtagttcttgg

SEQ ID NO: 3877 - DNA, 16 bp, Artificial sequence
  Synthetic oligonucleotide
aaagggagtagttctt

SEQ ID NO: 3878 - DNA, 16 bp, Artificial sequence
  Synthetic oligonucleotide
agaaagggagtagttc

SEQ ID NO: 3879 - DNA, 16 bp, Artificial sequence
  Synthetic oligonucleotide
gaagaaagggagtagt

SEQ ID NO: 3880 - DNA, 16 bp, Artificial sequence
  Synthetic oligonucleotide
ctgaagaaagggagta

SEQ ID NO: 3881 - DNA, 16 bp, Artificial sequence
  Synthetic oligonucleotide
tcaactgaagaaaggg

SEQ ID NO: 3882 - DNA, 16 bp, Artificial sequence
  Synthetic oligonucleotide
tcattgaagttttgtg

SEQ ID NO: 3883 - DNA, 16 bp, Artificial sequence
  Synthetic oligonucleotide
cgtttcattgaagttt

SEQ ID NO: 3884 - DNA, 16 bp, Artificial sequence
  Synthetic oligonucleotide
ttgtagttctcccacg

SEQ ID NO: 3885 - DNA, 16 bp, Artificial sequence
  Synthetic oligonucleotide
atttgtagttctccca

SEQ ID NO: 3886 - DNA, 16 bp, Artificial sequence
  Synthetic oligonucleotide
atatttgtagttctcc

SEQ ID NO: 3887 - DNA, 16 bp, Artificial sequence
  Synthetic oligonucleotide
ccatatttgtagttct

SEQ ID NO: 3888 - DNA, 16 bp, Artificial sequence
  Synthetic oligonucleotide
aaccatatttgtagtt

SEQ ID NO: 3889 - DNA, 16 bp, Artificial sequence
  Synthetic oligonucleotide
ccaaaaccatatttgt

SEQ ID NO: 3890 - DNA, 16 bp, Artificial sequence
  Synthetic oligonucleotide
ctcccaaaaccatatt

SEQ ID NO: 3891 - DNA, 16 bp, Artificial sequence
  Synthetic oligonucleotide
gcctcccaaaaccata

SEQ ID NO: 3892 - DNA, 16 bp, Artificial sequence
  Synthetic oligonucleotide
aagcctcccaaaacca

SEQ ID NO: 3893 - DNA, 16 bp, Artificial sequence
  Synthetic oligonucleotide
tcaagcctcccaaaac

SEQ ID NO: 3894 - DNA, 16 bp, Artificial sequence
  Synthetic oligonucleotide
tccatcaagcctccca

SEQ ID NO: 3895 - DNA, 16 bp, Artificial sequence
  Synthetic oligonucleotide
tctccatcaagcctcc

SEQ ID NO: 3896 - DNA, 16 bp, Artificial sequence
  Synthetic oligonucleotide
attctccatcaagcct

SEQ ID NO: 3897 - DNA, 16 bp, Artificial sequence
  Synthetic oligonucleotide
aaattctccatcaagc

SEQ ID NO: 3898 - DNA, 16 bp, Artificial sequence
  Synthetic oligonucleotide
accaaaattctccatc

SEQ ID NO: 3899 - DNA, 16 bp, Artificial sequence
  Synthetic oligonucleotide
caaccaaaattctcca

SEQ ID NO: 3900 - DNA, 16 bp, Artificial sequence
  Synthetic oligonucleotide
cccaaccaaaattctc

SEQ ID NO: 3901 - DNA, 16 bp, Artificial sequence
  Synthetic oligonucleotide
ggcccaaccaaaattc

SEQ ID NO: 3902 - DNA, 16 bp, Artificial sequence
  Synthetic oligonucleotide
taggcccaaccaaaat

SEQ ID NO: 3903 - DNA, 16 bp, Artificial sequence
  Synthetic oligonucleotide
tctaggcccaaccaaa

SEQ ID NO: 3904 - DNA, 16 bp, Artificial sequence
  Synthetic oligonucleotide
tctctaggcccaacca

SEQ ID NO: 3905 - DNA, 16 bp, Artificial sequence
  Synthetic oligonucleotide
cttctctaggcccaac

SEQ ID NO: 3906 - DNA, 16 bp, Artificial sequence
  Synthetic oligonucleotide
atatcttctctaggcc

SEQ ID NO: 3907 - DNA, 16 bp, Artificial sequence
  Synthetic oligonucleotide
gtatatcttctctagg

SEQ ID NO: 3908 - DNA, 16 bp, Artificial sequence
  Synthetic oligonucleotide
gagtatatcttctcta

SEQ ID NO: 3909 - DNA, 16 bp, Artificial sequence
  Synthetic oligonucleotide
tggagtatatcttctc

SEQ ID NO: 3910 - DNA, 16 bp, Artificial sequence
  Synthetic oligonucleotide
tatggagtatatcttc

SEQ ID NO: 3911 - DNA, 16 bp, Artificial sequence
  Synthetic oligonucleotide
actatggagtatatct

SEQ ID NO: 3912 - DNA, 16 bp, Artificial sequence
  Synthetic oligonucleotide
tcactatggagtatat

SEQ ID NO: 3913 - DNA, 16 bp, Artificial sequence
  Synthetic oligonucleotide
cttcactatggagtat

SEQ ID NO: 3914 - DNA, 16 bp, Artificial sequence
  Synthetic oligonucleotide
tgcttcactatggagt

SEQ ID NO: 3915 - DNA, 16 bp, Artificial sequence
  Synthetic oligonucleotide
attgcttcactatgga

SEQ ID NO: 3916 - DNA, 16 bp, Artificial sequence
  Synthetic oligonucleotide
agattgcttcactatg

SEQ ID NO: 3917 - DNA, 16 bp, Artificial sequence
  Synthetic oligonucleotide
ttagattgcttcacta

SEQ ID NO: 3918 - DNA, 16 bp, Artificial sequence
  Synthetic oligonucleotide
aattagattgcttcac

SEQ ID NO: 3919 - DNA, 16 bp, Artificial sequence
  Synthetic oligonucleotide
ataattagattgcttc

SEQ ID NO: 3920 - DNA, 16 bp, Artificial sequence
  Synthetic oligonucleotide
acataattagattgct

SEQ ID NO: 3921 - DNA, 16 bp, Artificial sequence
  Synthetic oligonucleotide
cgtaaaacataattag

SEQ ID NO: 3922 - DNA, 16 bp, Artificial sequence
  Synthetic oligonucleotide
cttccaactcaattcg

SEQ ID NO: 3923 - DNA, 16 bp, Artificial sequence
  Synthetic oligonucleotide
gtcttccaactcaatt

SEQ ID NO: 3924 - DNA, 16 bp, Artificial sequence
  Synthetic oligonucleotide
cagtcttccaactcaa

SEQ ID NO: 3925 - DNA, 16 bp, Artificial sequence
  Synthetic oligonucleotide
tccagtcttccaactc

SEQ ID NO: 3926 - DNA, 16 bp, Artificial sequence
  Synthetic oligonucleotide
tttccagtcttccaac

SEQ ID NO: 3927 - DNA, 16 bp, Artificial sequence
  Synthetic oligonucleotide
gtctttccagtcttcc

SEQ ID NO: 3928 - DNA, 16 bp, Artificial sequence
  Synthetic oligonucleotide
ttgttgtctttccagt

SEQ ID NO: 3929 - DNA, 16 bp, Artificial sequence
  Synthetic oligonucleotide
ataatgtttgttgtct

SEQ ID NO: 3930 - DNA, 16 bp, Artificial sequence
  Synthetic oligonucleotide
cgtatagttggtttcg

SEQ ID NO: 3931 - DNA, 16 bp, Artificial sequence
  Synthetic oligonucleotide
gcaactagatgtagcg

SEQ ID NO: 3932 - DNA, 16 bp, Artificial sequence
  Synthetic oligonucleotide
tcgcaactagatgtag

SEQ ID NO: 3933 - DNA, 16 bp, Artificial sequence
  Synthetic oligonucleotide
aatcgcaactagatgt

SEQ ID NO: 3934 - DNA, 16 bp, Artificial sequence
  Synthetic oligonucleotide
gtaatcgcaactagat

SEQ ID NO: 3935 - DNA, 16 bp, Artificial sequence
  Synthetic oligonucleotide
cagtaatcgcaactag

SEQ ID NO: 3936 - DNA, 16 bp, Artificial sequence
  Synthetic oligonucleotide
gccagtaatcgcaact

SEQ ID NO: 3937 - DNA, 16 bp, Artificial sequence
  Synthetic oligonucleotide
ttgccagtaatcgcaa

SEQ ID NO: 3938 - DNA, 16 bp, Artificial sequence
  Synthetic oligonucleotide
cattgccagtaatcgc

SEQ ID NO: 3939 - DNA, 16 bp, Artificial sequence
  Synthetic oligonucleotide
gacattgccagtaatc

SEQ ID NO: 3940 - DNA, 16 bp, Artificial sequence
  Synthetic oligonucleotide
gggacattgccagtaa

SEQ ID NO: 3941 - DNA, 16 bp, Artificial sequence
  Synthetic oligonucleotide
tccgggattgcattgg

SEQ ID NO: 3942 - DNA, 16 bp, Artificial sequence
  Synthetic oligonucleotide
tttccgggattgcatt

SEQ ID NO: 3943 - DNA, 16 bp, Artificial sequence
  Synthetic oligonucleotide
gttttccgggattgca

SEQ ID NO: 3944 - DNA, 16 bp, Artificial sequence
  Synthetic oligonucleotide
ttgttttccgggattg

SEQ ID NO: 3945 - DNA, 16 bp, Artificial sequence
  Synthetic oligonucleotide
ctttgttttccgggat

SEQ ID NO: 3946 - DNA, 16 bp, Artificial sequence
  Synthetic oligonucleotide
atctttgttttccggg

SEQ ID NO: 3947 - DNA, 16 bp, Artificial sequence
  Synthetic oligonucleotide
aaatctttgttttccg

SEQ ID NO: 3948 - DNA, 16 bp, Artificial sequence
  Synthetic oligonucleotide
acaccaaatctttgtt

SEQ ID NO: 3949 - DNA, 16 bp, Artificial sequence
  Synthetic oligonucleotide
aaacaccaaatctttg

SEQ ID NO: 3950 - DNA, 16 bp, Artificial sequence
  Synthetic oligonucleotide
caagtagaaaacacca

SEQ ID NO: 3951 - DNA, 16 bp, Artificial sequence
  Synthetic oligonucleotide
cccaagtagaaaacac

SEQ ID NO: 3952 - DNA, 16 bp, Artificial sequence
  Synthetic oligonucleotide
atcccaagtagaaaac

SEQ ID NO: 3953 - DNA, 16 bp, Artificial sequence
  Synthetic oligonucleotide
tgatcccaagtagaaa

SEQ ID NO: 3954 - DNA, 16 bp, Artificial sequence
  Synthetic oligonucleotide
tgtgatcccaagtaga

SEQ ID NO: 3955 - DNA, 16 bp, Artificial sequence
  Synthetic oligonucleotide
ctgatcaaatatgttg

SEQ ID NO: 3956 - DNA, 16 bp, Artificial sequence
  Synthetic oligonucleotide
gactgatcaaatatgt

SEQ ID NO: 3957 - DNA, 16 bp, Artificial sequence
  Synthetic oligonucleotide
aagactgatcaaatat

SEQ ID NO: 3958 - DNA, 16 bp, Artificial sequence
  Synthetic oligonucleotide
cataaaaagactgatc

SEQ ID NO: 3959 - DNA, 16 bp, Artificial sequence
  Synthetic oligonucleotide
gatcataaaaagactg

SEQ ID NO: 3960 - DNA, 16 bp, Artificial sequence
  Synthetic oligonucleotide
tagatcataaaaagac

SEQ ID NO: 3961 - DNA, 16 bp, Artificial sequence
  Synthetic oligonucleotide
gatagatcataaaaag

SEQ ID NO: 3962 - DNA, 16 bp, Artificial sequence
  Synthetic oligonucleotide
gcgatagatcataaaa

SEQ ID NO: 3963 - DNA, 16 bp, Artificial sequence
  Synthetic oligonucleotide
cagcgatagatcataa

SEQ ID NO: 3964 - DNA, 16 bp, Artificial sequence
  Synthetic oligonucleotide
tttgcagcgatagatc

SEQ ID NO: 3965 - DNA, 16 bp, Artificial sequence
  Synthetic oligonucleotide
ggtttgcagcgataga

SEQ ID NO: 3966 - DNA, 16 bp, Artificial sequence
  Synthetic oligonucleotide
cactggtttgcagcga

SEQ ID NO: 3967 - DNA, 16 bp, Artificial sequence
  Synthetic oligonucleotide
ttcactggtttgcagc

SEQ ID NO: 3968 - DNA, 16 bp, Artificial sequence
  Synthetic oligonucleotide
atttcactggtttgca

SEQ ID NO: 3969 - DNA, 16 bp, Artificial sequence
  Synthetic oligonucleotide
tgatttcactggtttg

SEQ ID NO: 3970 - DNA, 16 bp, Artificial sequence
  Synthetic oligonucleotide
tagttcttctcagttc

SEQ ID NO: 3971 - DNA, 16 bp, Artificial sequence
  Synthetic oligonucleotide
tgtagttcttctcagt

SEQ ID NO: 3972 - DNA, 16 bp, Artificial sequence
  Synthetic oligonucleotide
tatgtagttcttctca

SEQ ID NO: 3973 - DNA, 16 bp, Artificial sequence
  Synthetic oligonucleotide
tatatgtagttcttct

SEQ ID NO: 3974 - DNA, 16 bp, Artificial sequence
  Synthetic oligonucleotide
gtttatatgtagttct

SEQ ID NO: 3975 - DNA, 16 bp, Artificial sequence
  Synthetic oligonucleotide
gtagtttatatgtagt

SEQ ID NO: 3976 - DNA, 16 bp, Artificial sequence
  Synthetic oligonucleotide
cttgtagtttatatgt

SEQ ID NO: 3977 - DNA, 16 bp, Artificial sequence
  Synthetic oligonucleotide
gacttgtagtttatat

SEQ ID NO: 3978 - DNA, 16 bp, Artificial sequence
  Synthetic oligonucleotide
ttgacttgtagtttat

SEQ ID NO: 3979 - DNA, 16 bp, Artificial sequence
  Synthetic oligonucleotide
tttttgacttgtagtt

SEQ ID NO: 3980 - DNA, 16 bp, Artificial sequence
  Synthetic oligonucleotide
catttttgacttgtag

SEQ ID NO: 3981 - DNA, 16 bp, Artificial sequence
  Synthetic oligonucleotide
cctcttcatttttgac

SEQ ID NO: 3982 - DNA, 16 bp, Artificial sequence
  Synthetic oligonucleotide
gacatattctttacct

SEQ ID NO: 3983 - DNA, 16 bp, Artificial sequence
  Synthetic oligonucleotide
gtgacatattctttac

SEQ ID NO: 3984 - DNA, 16 bp, Artificial sequence
  Synthetic oligonucleotide
ttcaagtgacatattc

SEQ ID NO: 3985 - DNA, 16 bp, Artificial sequence
  Synthetic oligonucleotide
agttcaagtgacatat

SEQ ID NO: 3986 - DNA, 16 bp, Artificial sequence
  Synthetic oligonucleotide
tgagttcaagtgacat

SEQ ID NO: 3987 - DNA, 16 bp, Artificial sequence
  Synthetic oligonucleotide
gttgagttcaagtgac

SEQ ID NO: 3988 - DNA, 16 bp, Artificial sequence
  Synthetic oligonucleotide
gagttgagttcaagtg

SEQ ID NO: 3989 - DNA, 16 bp, Artificial sequence
  Synthetic oligonucleotide
ttgagttgagttcaag

SEQ ID NO: 3990 - DNA, 16 bp, Artificial sequence
  Synthetic oligonucleotide
ttttgagttgagttca

SEQ ID NO: 3991 - DNA, 16 bp, Artificial sequence
  Synthetic oligonucleotide
agttttgagttgagtt

SEQ ID NO: 3992 - DNA, 16 bp, Artificial sequence
  Synthetic oligonucleotide
caagttttgagttgag

SEQ ID NO: 3993 - DNA, 16 bp, Artificial sequence
  Synthetic oligonucleotide
ttcaagttttgagttg

SEQ ID NO: 3994 - DNA, 16 bp, Artificial sequence
  Synthetic oligonucleotide
ctttcaagttttgagt

SEQ ID NO: 3995 - DNA, 16 bp, Artificial sequence
  Synthetic oligonucleotide
ggctttcaagttttga

SEQ ID NO: 3996 - DNA, 16 bp, Artificial sequence
  Synthetic oligonucleotide
gaggctttcaagtttt

SEQ ID NO: 3997 - DNA, 16 bp, Artificial sequence
  Synthetic oligonucleotide
aggaggctttcaagtt

SEQ ID NO: 3998 - DNA, 16 bp, Artificial sequence
  Synthetic oligonucleotide
ctaggaggctttcaag

SEQ ID NO: 3999 - DNA, 16 bp, Artificial sequence
  Synthetic oligonucleotide
ttctaggaggctttca

SEQ ID NO: 4000 - DNA, 16 bp, Artificial sequence
  Synthetic oligonucleotide
tcttctaggaggcttt

SEQ ID NO: 4001 - DNA, 16 bp, Artificial sequence
  Synthetic oligonucleotide
tttcttctaggaggct

SEQ ID NO: 4002 - DNA, 16 bp, Artificial sequence
  Synthetic oligonucleotide
gttgaagtagaatttt

SEQ ID NO: 4003 - DNA, 16 bp, Artificial sequence
  Synthetic oligonucleotide
gttgctcttctaaata

SEQ ID NO: 4004 - DNA, 16 bp, Artificial sequence
  Synthetic oligonucleotide
tagttgctcttctaaa

SEQ ID NO: 4005 - DNA, 16 bp, Artificial sequence
  Synthetic oligonucleotide
gttagttgctcttcta

SEQ ID NO: 4006 - DNA, 16 bp, Artificial sequence
  Synthetic oligonucleotide
tagttagttgctcttc

SEQ ID NO: 4007 - DNA, 16 bp, Artificial sequence
  Synthetic oligonucleotide
aagttagttagttgct

SEQ ID NO: 4008 - DNA, 16 bp, Artificial sequence
  Synthetic oligonucleotide
ttaagttagttagttg

SEQ ID NO: 4009 - DNA, 16 bp, Artificial sequence
  Synthetic oligonucleotide
aattaagttagttagt

SEQ ID NO: 4010 - DNA, 16 bp, Artificial sequence
  Synthetic oligonucleotide
tgaattaagttagtta

SEQ ID NO: 4011 - DNA, 16 bp, Artificial sequence
  Synthetic oligonucleotide
tttgaattaagttagt

SEQ ID NO: 4012 - DNA, 16 bp, Artificial sequence
  Synthetic oligonucleotide
ggttgattttgaatta

SEQ ID NO: 4013 - DNA, 16 bp, Artificial sequence
  Synthetic oligonucleotide
caggttgattttgaat

SEQ ID NO: 4014 - DNA, 16 bp, Artificial sequence
  Synthetic oligonucleotide
ttcaggttgattttga

SEQ ID NO: 4015 - DNA, 16 bp, Artificial sequence
  Synthetic oligonucleotide
gtttcaggttgatttt

SEQ ID NO: 4016 - DNA, 16 bp, Artificial sequence
  Synthetic oligonucleotide
gagtttcaggttgatt

SEQ ID NO: 4017 - DNA, 16 bp, Artificial sequence
  Synthetic oligonucleotide
tggagtttcaggttga

SEQ ID NO: 4018 - DNA, 16 bp, Artificial sequence
  Synthetic oligonucleotide
ttctggagtttcaggt

SEQ ID NO: 4019 - DNA, 16 bp, Artificial sequence
  Synthetic oligonucleotide
tgttctggagtttcag

SEQ ID NO: 4020 - DNA, 16 bp, Artificial sequence
  Synthetic oligonucleotide
ggtgttctggagtttc

SEQ ID NO: 4021 - DNA, 16 bp, Artificial sequence
  Synthetic oligonucleotide
tgggtgttctggagtt

SEQ ID NO: 4022 - DNA, 16 bp, Artificial sequence
  Synthetic oligonucleotide
tctgggtgttctggag

SEQ ID NO: 4023 - DNA, 16 bp, Artificial sequence
  Synthetic oligonucleotide
cttctgggtgttctgg

SEQ ID NO: 4024 - DNA, 16 bp, Artificial sequence
  Synthetic oligonucleotide
tacttctgggtgttct

SEQ ID NO: 4025 - DNA, 16 bp, Artificial sequence
  Synthetic oligonucleotide
gttacttctgggtgtt

SEQ ID NO: 4026 - DNA, 16 bp, Artificial sequence
  Synthetic oligonucleotide
aagttacttctgggtg

SEQ ID NO: 4027 - DNA, 16 bp, Artificial sequence
  Synthetic oligonucleotide
ccatcatgttttacat

SEQ ID NO: 4028 - DNA, 16 bp, Artificial sequence
  Synthetic oligonucleotide
tgccatcatgttttac

SEQ ID NO: 4029 - DNA, 16 bp, Artificial sequence
  Synthetic oligonucleotide
gaatgccatcatgttt

SEQ ID NO: 4030 - DNA, 16 bp, Artificial sequence
  Synthetic oligonucleotide
aggaatgccatcatgt

SEQ ID NO: 4031 - DNA, 16 bp, Artificial sequence
  Synthetic oligonucleotide
gcaggaatgccatcat

SEQ ID NO: 4032 - DNA, 16 bp, Artificial sequence
  Synthetic oligonucleotide
cagcaggaatgccatc

SEQ ID NO: 4033 - DNA, 16 bp, Artificial sequence
  Synthetic oligonucleotide
ttcagcaggaatgcca

SEQ ID NO: 4034 - DNA, 16 bp, Artificial sequence
  Synthetic oligonucleotide
cattcagcaggaatgc

SEQ ID NO: 4035 - DNA, 16 bp, Artificial sequence
  Synthetic oligonucleotide
tacattcagcaggaat

SEQ ID NO: 4036 - DNA, 16 bp, Artificial sequence
  Synthetic oligonucleotide
ggtacattcagcagga

SEQ ID NO: 4037 - DNA, 16 bp, Artificial sequence
  Synthetic oligonucleotide
gtggtacattcagcag

SEQ ID NO: 4038 - DNA, 16 bp, Artificial sequence
  Synthetic oligonucleotide
tggtggtacattcagc

SEQ ID NO: 4039 - DNA, 16 bp, Artificial sequence
  Synthetic oligonucleotide
tataaatggtggtaca

SEQ ID NO: 4040 - DNA, 16 bp, Artificial sequence
  Synthetic oligonucleotide
gttataaatggtggta

SEQ ID NO: 4041 - DNA, 16 bp, Artificial sequence
  Synthetic oligonucleotide
ctgttataaatggtgg

SEQ ID NO: 4042 - DNA, 16 bp, Artificial sequence
  Synthetic oligonucleotide
ctctgttataaatggt

SEQ ID NO: 4043 - DNA, 16 bp, Artificial sequence
  Synthetic oligonucleotide
acctctgttataaatg

SEQ ID NO: 4044 - DNA, 16 bp, Artificial sequence
  Synthetic oligonucleotide
tcacctctgttataaa

SEQ ID NO: 4045 - DNA, 16 bp, Artificial sequence
  Synthetic oligonucleotide
gttcacctctgttata

SEQ ID NO: 4046 - DNA, 16 bp, Artificial sequence
  Synthetic oligonucleotide
atgttcacctctgtta

SEQ ID NO: 4047 - DNA, 16 bp, Artificial sequence
  Synthetic oligonucleotide
ttgtatgttcacctct

SEQ ID NO: 4048 - DNA, 16 bp, Artificial sequence
  Synthetic oligonucleotide
acttgtatgttcacct

SEQ ID NO: 4049 - DNA, 16 bp, Artificial sequence
  Synthetic oligonucleotide
ccacttgtatgttcac

SEQ ID NO: 4050 - DNA, 16 bp, Artificial sequence
  Synthetic oligonucleotide
tgccacttgtatgttc

SEQ ID NO: 4051 - DNA, 16 bp, Artificial sequence
  Synthetic oligonucleotide
catgccacttgtatgt

SEQ ID NO: 4052 - DNA, 16 bp, Artificial sequence
  Synthetic oligonucleotide
tacatgccacttgtat

SEQ ID NO: 4053 - DNA, 16 bp, Artificial sequence
  Synthetic oligonucleotide
catacatgccacttgt

SEQ ID NO: 4054 - DNA, 16 bp, Artificial sequence
  Synthetic oligonucleotide
ggcatacatgccactt

SEQ ID NO: 4055 - DNA, 16 bp, Artificial sequence
  Synthetic oligonucleotide
atggcatacatgccac

SEQ ID NO: 4056 - DNA, 16 bp, Artificial sequence
  Synthetic oligonucleotide
tgatggcatacatgcc

SEQ ID NO: 4057 - DNA, 16 bp, Artificial sequence
  Synthetic oligonucleotide
tctgatggcatacatg

SEQ ID NO: 4058 - DNA, 16 bp, Artificial sequence
  Synthetic oligonucleotide
ggtctgatggcataca

SEQ ID NO: 4059 - DNA, 16 bp, Artificial sequence
  Synthetic oligonucleotide
tgggtctgatggcata

SEQ ID NO: 4060 - DNA, 16 bp, Artificial sequence
  Synthetic oligonucleotide
gttgctgggtctgatg

SEQ ID NO: 4061 - DNA, 16 bp, Artificial sequence
  Synthetic oligonucleotide
gagagttgctgggtct

SEQ ID NO: 4062 - DNA, 16 bp, Artificial sequence
  Synthetic oligonucleotide
ttgagagttgctgggt

SEQ ID NO: 4063 - DNA, 16 bp, Artificial sequence
  Synthetic oligonucleotide
acttgagagttgctgg

SEQ ID NO: 4064 - DNA, 16 bp, Artificial sequence
  Synthetic oligonucleotide
aaaaacttgagagttg

SEQ ID NO: 4065 - DNA, 16 bp, Artificial sequence
  Synthetic oligonucleotide
tgaaaaacttgagagt

SEQ ID NO: 4066 - DNA, 16 bp, Artificial sequence
  Synthetic oligonucleotide
catgaaaaacttgaga

SEQ ID NO: 4067 - DNA, 16 bp, Artificial sequence
  Synthetic oligonucleotide
gacatgaaaaacttga

SEQ ID NO: 4068 - DNA, 16 bp, Artificial sequence
  Synthetic oligonucleotide
tcacagtagacatgaa

SEQ ID NO: 4069 - DNA, 16 bp, Artificial sequence
  Synthetic oligonucleotide
catcacagtagacatg

SEQ ID NO: 4070 - DNA, 16 bp, Artificial sequence
  Synthetic oligonucleotide
aacatcacagtagaca

SEQ ID NO: 4071 - DNA, 16 bp, Artificial sequence
  Synthetic oligonucleotide
ataacatcacagtaga

SEQ ID NO: 4072 - DNA, 16 bp, Artificial sequence
  Synthetic oligonucleotide
atataacatcacagta

SEQ ID NO: 4073 - DNA, 16 bp, Artificial sequence
  Synthetic oligonucleotide
tgatataacatcacag

SEQ ID NO: 4074 - DNA, 16 bp, Artificial sequence
  Synthetic oligonucleotide
cctgatataacatcac

SEQ ID NO: 4075 - DNA, 16 bp, Artificial sequence
  Synthetic oligonucleotide
tacctgatataacatc

SEQ ID NO: 4076 - DNA, 16 bp, Artificial sequence
  Synthetic oligonucleotide
actacctgatataaca

SEQ ID NO: 4077 - DNA, 16 bp, Artificial sequence
  Synthetic oligonucleotide
ggactacctgatataa

SEQ ID NO: 4078 - DNA, 16 bp, Artificial sequence
  Synthetic oligonucleotide
atggactacctgatat

SEQ ID NO: 4079 - DNA, 16 bp, Artificial sequence
  Synthetic oligonucleotide
ccatggactacctgat

SEQ ID NO: 4080 - DNA, 16 bp, Artificial sequence
  Synthetic oligonucleotide
atgtccatggactacc

SEQ ID NO: 4081 - DNA, 16 bp, Artificial sequence
  Synthetic oligonucleotide
taatgtccatggacta

SEQ ID NO: 4082 - DNA, 16 bp, Artificial sequence
  Synthetic oligonucleotide
attaatgtccatggac

SEQ ID NO: 4083 - DNA, 16 bp, Artificial sequence
  Synthetic oligonucleotide
gaattaatgtccatgg

SEQ ID NO: 4084 - DNA, 16 bp, Artificial sequence
  Synthetic oligonucleotide
ttgaattaatgtccat

SEQ ID NO: 4085 - DNA, 16 bp, Artificial sequence
  Synthetic oligonucleotide
tgttgaattaatgtcc

SEQ ID NO: 4086 - DNA, 16 bp, Artificial sequence
  Synthetic oligonucleotide
gatgttgaattaatgt

SEQ ID NO: 4087 - DNA, 16 bp, Artificial sequence
  Synthetic oligonucleotide
tcgatgttgaattaat

SEQ ID NO: 4088 - DNA, 16 bp, Artificial sequence
  Synthetic oligonucleotide
attcgatgttgaatta

SEQ ID NO: 4089 - DNA, 16 bp, Artificial sequence
  Synthetic oligonucleotide
ctattcgatgttgaat

SEQ ID NO: 4090 - DNA, 16 bp, Artificial sequence
  Synthetic oligonucleotide
atctattcgatgttga

SEQ ID NO: 4091 - DNA, 16 bp, Artificial sequence
  Synthetic oligonucleotide
atccatctattcgatg

SEQ ID NO: 4092 - DNA, 16 bp, Artificial sequence
  Synthetic oligonucleotide
tgatccatctattcga

SEQ ID NO: 4093 - DNA, 16 bp, Artificial sequence
  Synthetic oligonucleotide
tgtgatccatctattc

SEQ ID NO: 4094 - DNA, 16 bp, Artificial sequence
  Synthetic oligonucleotide
tttgtgatccatctat

SEQ ID NO: 4095 - DNA, 16 bp, Artificial sequence
  Synthetic oligonucleotide
gttttgtgatccatct

SEQ ID NO: 4096 - DNA, 16 bp, Artificial sequence
  Synthetic oligonucleotide
aagttttgtgatccat

SEQ ID NO: 4097 - DNA, 16 bp, Artificial sequence
  Synthetic oligonucleotide
tgaagttttgtgatcc

SEQ ID NO: 4098 - DNA, 16 bp, Artificial sequence
  Synthetic oligonucleotide
attgaagttttgtgat

SEQ ID NO: 4099 - DNA, 16 bp, Artificial sequence
  Synthetic oligonucleotide
caacattttggttgat

SEQ ID NO: 4100 - DNA, 16 bp, Artificial sequence
  Synthetic oligonucleotide
gatcaacattttggtt

SEQ ID NO: 4101 - DNA, 16 bp, Artificial sequence
  Synthetic oligonucleotide
gatggatcaacatttt

SEQ ID NO: 4102 - DNA, 16 bp, Artificial sequence
  Synthetic oligonucleotide
gttggatggatcaaca

SEQ ID NO: 4103 - DNA, 16 bp, Artificial sequence
  Synthetic oligonucleotide
ctgttggatggatcaa

SEQ ID NO: 4104 - DNA, 16 bp, Artificial sequence
  Synthetic oligonucleotide
atctgttggatggatc

SEQ ID NO: 4105 - DNA, 16 bp, Artificial sequence
  Synthetic oligonucleotide
ctgaatctgttggatg

SEQ ID NO: 4106 - DNA, 16 bp, Artificial sequence
  Synthetic oligonucleotide
caaagctttctgaatc

SEQ ID NO: 4107 - DNA, 16 bp, Artificial sequence
  Synthetic oligonucleotide
ctcagttcattcaaag

SEQ ID NO: 4108 - DNA, 16 bp, Artificial sequence
  Synthetic oligonucleotide
gcctcagttcattcaa

SEQ ID NO: 4109 - DNA, 16 bp, Artificial sequence
  Synthetic oligonucleotide
ttgcctcagttcattc

SEQ ID NO: 4110 - DNA, 16 bp, Artificial sequence
  Synthetic oligonucleotide
atttgcctcagttcat

SEQ ID NO: 4111 - DNA, 16 bp, Artificial sequence
  Synthetic oligonucleotide
aaatttgcctcagttc

SEQ ID NO: 4112 - DNA, 16 bp, Artificial sequence
  Synthetic oligonucleotide
tttaaatttgcctcag

SEQ ID NO: 4113 - DNA, 16 bp, Artificial sequence
  Synthetic oligonucleotide
cttttaaatttgcctc

SEQ ID NO: 4114 - DNA, 16 bp, Artificial sequence
  Synthetic oligonucleotide
gccttttaaatttgcc

SEQ ID NO: 4115 - DNA, 16 bp, Artificial sequence
  Synthetic oligonucleotide
gtttaaattattgcct

SEQ ID NO: 4116 - DNA, 16 bp, Artificial sequence
  Synthetic oligonucleotide
atgaggttaatgttta

SEQ ID NO: 4117 - DNA, 16 bp, Artificial sequence
  Synthetic oligonucleotide
gaatgaggttaatgtt

SEQ ID NO: 4118 - DNA, 16 bp, Artificial sequence
  Synthetic oligonucleotide
tggaatgaggttaatg

SEQ ID NO: 4119 - DNA, 16 bp, Artificial sequence
  Synthetic oligonucleotide
cttggaatgaggttaa

SEQ ID NO: 4120 - DNA, 16 bp, Artificial sequence
  Synthetic oligonucleotide
aacttggaatgaggtt

SEQ ID NO: 4121 - DNA, 16 bp, Artificial sequence
  Synthetic oligonucleotide
cattaacttggaatga

SEQ ID NO: 4122 - DNA, 16 bp, Artificial sequence
  Synthetic oligonucleotide
cacattaacttggaat

SEQ ID NO: 4123 - DNA, 16 bp, Artificial sequence
  Synthetic oligonucleotide
accacattaacttgga

SEQ ID NO: 4124 - DNA, 16 bp, Artificial sequence
  Synthetic oligonucleotide
ttagaccacattaact

SEQ ID NO: 4125 - DNA, 16 bp, Artificial sequence
  Synthetic oligonucleotide
tattagaccacattaa

SEQ ID NO: 4126 - DNA, 16 bp, Artificial sequence
  Synthetic oligonucleotide
attattagaccacatt

SEQ ID NO: 4127 - DNA, 16 bp, Artificial sequence
  Synthetic oligonucleotide
taccagattattagac

SEQ ID NO: 4128 - DNA, 16 bp, Artificial sequence
  Synthetic oligonucleotide
aataccagattattag

SEQ ID NO: 4129 - DNA, 16 bp, Artificial sequence
  Synthetic oligonucleotide
ttaataccagattatt

SEQ ID NO: 4130 - DNA, 16 bp, Artificial sequence
  Synthetic oligonucleotide
atttaataccagatta

SEQ ID NO: 4131 - DNA, 16 bp, Artificial sequence
  Synthetic oligonucleotide
ggatttaataccagat

SEQ ID NO: 4132 - DNA, 16 bp, Artificial sequence
  Synthetic oligonucleotide
aaggatttaataccag

SEQ ID NO: 4133 - DNA, 16 bp, Artificial sequence
  Synthetic oligonucleotide
ttaaggatttaatacc

SEQ ID NO: 4134 - DNA, 16 bp, Artificial sequence
  Synthetic oligonucleotide
ctcttaaggatttaat

SEQ ID NO: 4135 - DNA, 16 bp, Artificial sequence
  Synthetic oligonucleotide
ttctcttaaggattta

SEQ ID NO: 4136 - DNA, 16 bp, Artificial sequence
  Synthetic oligonucleotide
gctttctcttaaggat

SEQ ID NO: 4137 - DNA, 16 bp, Artificial sequence
  Synthetic oligonucleotide
aagctttctcttaagg

SEQ ID NO: 4138 - DNA, 16 bp, Artificial sequence
  Synthetic oligonucleotide
tcaagctttctcttaa

SEQ ID NO: 4139 - DNA, 16 bp, Artificial sequence
  Synthetic oligonucleotide
agtgactttaagataa

SEQ ID NO: 4140 - DNA, 16 bp, Artificial sequence
  Synthetic oligonucleotide
acagtgactttaagat

SEQ ID NO: 4141 - DNA, 16 bp, Artificial sequence
  Synthetic oligonucleotide
agacagtgactttaag

SEQ ID NO: 4142 - DNA, 16 bp, Artificial sequence
  Synthetic oligonucleotide
aaatagacagtgactt

SEQ ID NO: 4143 - DNA, 16 bp, Artificial sequence
  Synthetic oligonucleotide
ttaaatagacagtgac

SEQ ID NO: 4144 - DNA, 16 bp, Artificial sequence
  Synthetic oligonucleotide
tcttaaatagacagtg

SEQ ID NO: 4145 - DNA, 16 bp, Artificial sequence
  Synthetic oligonucleotide
aatcttaaatagacag

SEQ ID NO: 4146 - DNA, 16 bp, Artificial sequence
  Synthetic oligonucleotide
ttaatcttaaatagac

SEQ ID NO: 4147 - DNA, 16 bp, Artificial sequence
  Synthetic oligonucleotide
gtttaatcttaaatag

SEQ ID NO: 4148 - DNA, 16 bp, Artificial sequence
  Synthetic oligonucleotide
gtatgtttaatcttaa

SEQ ID NO: 4149 - DNA, 16 bp, Artificial sequence
  Synthetic oligonucleotide
attgtatgtttaatct

SEQ ID NO: 4150 - DNA, 16 bp, Artificial sequence
  Synthetic oligonucleotide
gtgattgtatgtttaa

SEQ ID NO: 4151 - DNA, 16 bp, Artificial sequence
  Synthetic oligonucleotide
tatgtgattgtatgtt

SEQ ID NO: 4152 - DNA, 16 bp, Artificial sequence
  Synthetic oligonucleotide
gttatgtgattgtatg

SEQ ID NO: 4153 - DNA, 16 bp, Artificial sequence
  Synthetic oligonucleotide
aggttatgtgattgta

SEQ ID NO: 4154 - DNA, 16 bp, Artificial sequence
  Synthetic oligonucleotide
taaggttatgtgattg

SEQ ID NO: 4155 - DNA, 16 bp, Artificial sequence
  Synthetic oligonucleotide
tttaaggttatgtgat

SEQ ID NO: 4156 - DNA, 16 bp, Artificial sequence
  Synthetic oligonucleotide
tctttaaggttatgtg

SEQ ID NO: 4157 - DNA, 16 bp, Artificial sequence
  Synthetic oligonucleotide
attctttaaggttatg

SEQ ID NO: 4158 - DNA, 16 bp, Artificial sequence
  Synthetic oligonucleotide
gtattctttaaggtta

SEQ ID NO: 4159 - DNA, 16 bp, Artificial sequence
  Synthetic oligonucleotide
cggtattctttaaggt

SEQ ID NO: 4160 - DNA, 16 bp, Artificial sequence
  Synthetic oligonucleotide
aacggtattctttaag

SEQ ID NO: 4161 - DNA, 16 bp, Artificial sequence
  Synthetic oligonucleotide
taaacggtattcttta

SEQ ID NO: 4162 - DNA, 16 bp, Artificial sequence
  Synthetic oligonucleotide
tgtaaacggtattctt

SEQ ID NO: 4163 - DNA, 16 bp, Artificial sequence
  Synthetic oligonucleotide
aatgtaaacggtattc

SEQ ID NO: 4164 - DNA, 16 bp, Artificial sequence
  Synthetic oligonucleotide
tctggaagcagaccta

SEQ ID NO: 4165 - DNA, 16 bp, Artificial sequence
  Synthetic oligonucleotide
cttctggaagcagacc

SEQ ID NO: 4166 - DNA, 16 bp, Artificial sequence
  Synthetic oligonucleotide
aaataaggtatagtga

SEQ ID NO: 4167 - DNA, 16 bp, Artificial sequence
  Synthetic oligonucleotide
tagtattaagtgttaa

SEQ ID NO: 4168 - DNA, 16 bp, Artificial sequence
  Synthetic oligonucleotide
tcatagtattaagtgt

SEQ ID NO: 4169 - DNA, 16 bp, Artificial sequence
  Synthetic oligonucleotide
agattcctttacaatt

SEQ ID NO: 4170 - DNA, 16 bp, Artificial sequence
  Synthetic oligonucleotide
acaagattcctttaca

SEQ ID NO: 4171 - DNA, 16 bp, Artificial sequence
  Synthetic oligonucleotide
ctgacaagattccttt

SEQ ID NO: 4172 - DNA, 16 bp, Artificial sequence
  Synthetic oligonucleotide
tgtaatctgacaagat

SEQ ID NO: 4173 - DNA, 16 bp, Artificial sequence
  Synthetic oligonucleotide
tactgtaatctgacaa

SEQ ID NO: 4174 - DNA, 16 bp, Artificial sequence
  Synthetic oligonucleotide
tcttactgtaatctga

SEQ ID NO: 4175 - DNA, 16 bp, Artificial sequence
  Synthetic oligonucleotide
cattcttactgtaatc

SEQ ID NO: 4176 - DNA, 16 bp, Artificial sequence
  Synthetic oligonucleotide
gttcattcttactgta

SEQ ID NO: 4177 - DNA, 16 bp, Artificial sequence
  Synthetic oligonucleotide
atatgttcattcttac

SEQ ID NO: 4178 - DNA, 16 bp, Artificial sequence
  Synthetic oligonucleotide
gccacaaatatgttca

SEQ ID NO: 4179 - DNA, 16 bp, Artificial sequence
  Synthetic oligonucleotide
gatgccacaaatatgt

SEQ ID NO: 4180 - DNA, 16 bp, Artificial sequence
  Synthetic oligonucleotide
ctttaactcgatgcca

SEQ ID NO: 4181 - DNA, 16 bp, Artificial sequence
  Synthetic oligonucleotide
aaactttaactcgatg

SEQ ID NO: 4182 - DNA, 16 bp, Artificial sequence
  Synthetic oligonucleotide
tataaactttaactcg

SEQ ID NO: 4183 - DNA, 16 bp, Artificial sequence
  Synthetic oligonucleotide
cacagcatatttaggg

SEQ ID NO: 4184 - DNA, 16 bp, Artificial sequence
  Synthetic oligonucleotide
tagaatcacagcatat

SEQ ID NO: 4185 - DNA, 16 bp, Artificial sequence
  Synthetic oligonucleotide
tattagaatcacagca

SEQ ID NO: 4186 - DNA, 16 bp, Artificial sequence
  Synthetic oligonucleotide
aatgtattagaatcac

SEQ ID NO: 4187 - DNA, 16 bp, Artificial sequence
  Synthetic oligonucleotide
acgaatgtattagaat

SEQ ID NO: 4188 - DNA, 16 bp, Artificial sequence
  Synthetic oligonucleotide
tacacgaatgtattag

SEQ ID NO: 4189 - DNA, 16 bp, Artificial sequence
  Synthetic oligonucleotide
acctacacgaatgtat

SEQ ID NO: 4190 - DNA, 16 bp, Artificial sequence
  Synthetic oligonucleotide
aaaacctacacgaatg

SEQ ID NO: 4191 - DNA, 16 bp, Artificial sequence
  Synthetic oligonucleotide
ttgaaaacctacacga

SEQ ID NO: 4192 - DNA, 16 bp, Artificial sequence
  Synthetic oligonucleotide
tacttgaaaacctaca

SEQ ID NO: 4193 - DNA, 16 bp, Artificial sequence
  Synthetic oligonucleotide
gtttatttctacttga

SEQ ID NO: 4194 - DNA, 16 bp, Artificial sequence
  Synthetic oligonucleotide
gaggtttatttctact

SEQ ID NO: 4195 - DNA, 16 bp, Artificial sequence
  Synthetic oligonucleotide
tacgaggtttatttct

SEQ ID NO: 4196 - DNA, 16 bp, Artificial sequence
  Synthetic oligonucleotide
tgttacgaggtttatt

SEQ ID NO: 4197 - DNA, 16 bp, Artificial sequence
  Synthetic oligonucleotide
acttgttacgaggttt

SEQ ID NO: 4198 - DNA, 16 bp, Artificial sequence
  Synthetic oligonucleotide
cagtaacttgttacga

SEQ ID NO: 4199 - DNA, 16 bp, Artificial sequence
  Synthetic oligonucleotide
gttcagtaacttgtta

SEQ ID NO: 4200 - DNA, 16 bp, Artificial sequence
  Synthetic oligonucleotide
tcaggctgtttaaacg

SEQ ID NO: 4201 - DNA, 16 bp, Artificial sequence
  Synthetic oligonucleotide
ttgtcaggctgtttaa

SEQ ID NO: 4202 - DNA, 16 bp, Artificial sequence
  Synthetic oligonucleotide
tatacatgcttgtcag

SEQ ID NO: 4203 - DNA, 16 bp, Artificial sequence
  Synthetic oligonucleotide
gtctttgtttattgaa

SEQ ID NO: 4204 - DNA, 16 bp, Artificial sequence
  Synthetic oligonucleotide
tgggtctttgtttatt

SEQ ID NO: 4205 - DNA, 16 bp, Artificial sequence
  Synthetic oligonucleotide
gactgggtctttgttt

SEQ ID NO: 4206 - DNA, 16 bp, Artificial sequence
  Synthetic oligonucleotide
ataatttagggactgg

SEQ ID NO: 4207 - DNA, 16 bp, Artificial sequence
  Synthetic oligonucleotide
tctataatttagggac

SEQ ID NO: 4208 - DNA, 16 bp, Artificial sequence
  Synthetic oligonucleotide
cgataaacatgcaaga

SEQ ID NO: 4209 - DNA, 16 bp, Artificial sequence
  Synthetic oligonucleotide
tgtcgataaacatgca

SEQ ID NO: 4210 - DNA, 16 bp, Artificial sequence
  Synthetic oligonucleotide
tgatgtcgataaacat

SEQ ID NO: 4211 - DNA, 16 bp, Artificial sequence
  Synthetic oligonucleotide
ttgtgatgtcgataaa

SEQ ID NO: 4212 - DNA, 16 bp, Artificial sequence
  Synthetic oligonucleotide
ctgttgtgatgtcgat

SEQ ID NO: 4213 - DNA, 16 bp, Artificial sequence
  Synthetic oligonucleotide
gatctgttgtgatgtc

SEQ ID NO: 4214 - DNA, 16 bp, Artificial sequence
  Synthetic oligonucleotide
agggatctgttgtgat

SEQ ID NO: 4215 - DNA, 16 bp, Artificial sequence
  Synthetic oligonucleotide
tttagggatctgttgt

SEQ ID NO: 4216 - DNA, 16 bp, Artificial sequence
  Synthetic oligonucleotide
ggatttagggatctgt

SEQ ID NO: 4217 - DNA, 16 bp, Artificial sequence
  Synthetic oligonucleotide
gatttagggatttagg

SEQ ID NO: 4218 - DNA, 16 bp, Artificial sequence
  Synthetic oligonucleotide
tctttagggatttagg

SEQ ID NO: 4219 - DNA, 16 bp, Artificial sequence
  Synthetic oligonucleotide
taatctttagggattt

SEQ ID NO: 4220 - DNA, 16 bp, Artificial sequence
  Synthetic oligonucleotide
atctaatctttaggga

SEQ ID NO: 4221 - DNA, 16 bp, Artificial sequence
  Synthetic oligonucleotide
tgtatctaatctttag

SEQ ID NO: 4222 - DNA, 16 bp, Artificial sequence
  Synthetic oligonucleotide
aaatttgtatctaatc

SEQ ID NO: 4223 - DNA, 16 bp, Artificial sequence
  Synthetic oligonucleotide
gtaaaaaatttgtatc

SEQ ID NO: 4224 - DNA, 16 bp, Artificial sequence
  Synthetic oligonucleotide
gtggtaaaaaatttgt

SEQ ID NO: 4225 - DNA, 16 bp, Artificial sequence
  Synthetic oligonucleotide
gatactgtggtaaaaa

SEQ ID NO: 4226 - DNA, 16 bp, Artificial sequence
  Synthetic oligonucleotide
agtgatactgtggtaa

SEQ ID NO: 4227 - DNA, 16 bp, Artificial sequence
  Synthetic oligonucleotide
acaagtgatactgtgg

SEQ ID NO: 4228 - DNA, 16 bp, Artificial sequence
  Synthetic oligonucleotide
ctgacaagtgatactg

SEQ ID NO: 4229 - DNA, 16 bp, Artificial sequence
  Synthetic oligonucleotide
attctgacaagtgata

SEQ ID NO: 4230 - DNA, 16 bp, Artificial sequence
  Synthetic oligonucleotide
taaattctgacaagtg

SEQ ID NO: 4231 - DNA, 16 bp, Artificial sequence
  Synthetic oligonucleotide
tactggcagttttaaa

SEQ ID NO: 4232 - DNA, 16 bp, Artificial sequence
  Synthetic oligonucleotide
tcttactggcagtttt

SEQ ID NO: 4233 - DNA, 16 bp, Artificial sequence
  Synthetic oligonucleotide
atttcttactggcagt

SEQ ID NO: 4234 - DNA, 16 bp, Artificial sequence
  Synthetic oligonucleotide
aaaatttcttactggc

SEQ ID NO: 4235 - DNA, 16 bp, Artificial sequence
  Synthetic oligonucleotide
aacaaatgggtttaat

SEQ ID NO: 4236 - DNA, 16 bp, Artificial sequence
  Synthetic oligonucleotide
gaatatttgcaagtct

SEQ ID NO: 4237 - DNA, 16 bp, Artificial sequence
  Synthetic oligonucleotide
tcattggtagaggaat

SEQ ID NO: 4238 - DNA, 16 bp, Artificial sequence
  Synthetic oligonucleotide
atattttaaagtctcg

SEQ ID NO: 4239 - DNA, 16 bp, Artificial sequence
  Synthetic oligonucleotide
gttacattattataga

SEQ ID NO: 4240 - DNA, 16 bp, Artificial sequence
  Synthetic oligonucleotide
gtgaaatgtgttacat

SEQ ID NO: 4241 - DNA, 16 bp, Artificial sequence
  Synthetic oligonucleotide
tcaccagtgaaatgtg

SEQ ID NO: 4242 - DNA, 16 bp, Artificial sequence
  Synthetic oligonucleotide
catgtttcaccagtga

SEQ ID NO: 4243 - DNA, 16 bp, Artificial sequence
  Synthetic oligonucleotide
acaagacatgtttcac

SEQ ID NO: 4244 - DNA, 16 bp, Artificial sequence
  Synthetic oligonucleotide
catatgacaagacatg

SEQ ID NO: 4245 - DNA, 16 bp, Artificial sequence
  Synthetic oligonucleotide
ctataatgcatatgac

SEQ ID NO: 4246 - DNA, 16 bp, Artificial sequence
  Synthetic oligonucleotide
tcctttctataatgca

SEQ ID NO: 4247 - DNA, 16 bp, Artificial sequence
  Synthetic oligonucleotide
tgattatcctttctat

SEQ ID NO: 4248 - DNA, 16 bp, Artificial sequence
  Synthetic oligonucleotide
taactgaaagtctgat

SEQ ID NO: 4249 - DNA, 16 bp, Artificial sequence
  Synthetic oligonucleotide
gtgcacaaaaatgtta

SEQ ID NO: 4250 - DNA, 16 bp, Artificial sequence
  Synthetic oligonucleotide
agctatgtgcacaaaa

SEQ ID NO: 4251 - DNA, 16 bp, Artificial sequence
  Synthetic oligonucleotide
gaagatagctatgtgc

SEQ ID NO: 4252 - DNA, 16 bp, Artificial sequence
  Synthetic oligonucleotide
tttattgaagatagct

SEQ ID NO: 4253 - DNA, 16 bp, Artificial sequence
  Synthetic oligonucleotide
tcattttagtgtatct

SEQ ID NO: 4254 - DNA, 16 bp, Artificial sequence
  Synthetic oligonucleotide
ccttgatcattttagt

SEQ ID NO: 4255 - DNA, 16 bp, Artificial sequence
  Synthetic oligonucleotide
tgaatcccttgatcat

SEQ ID NO: 4256 - DNA, 16 bp, Artificial sequence
  Synthetic oligonucleotide
gttgtttagtcttgaa

SEQ ID NO: 4257 - DNA, 16 bp, Artificial sequence
  Synthetic oligonucleotide
aattgagttgtttagt

SEQ ID NO: 4258 - DNA, 16 bp, Artificial sequence
  Synthetic oligonucleotide
gcaactaattgagttg

SEQ ID NO: 4259 - DNA, 16 bp, Artificial sequence
  Synthetic oligonucleotide
attggtgcaactaatt

SEQ ID NO: 4260 - DNA, 16 bp, Artificial sequence
  Synthetic oligonucleotide
gttttttattggtgca

SEQ ID NO: 4261 - DNA, 16 bp, Artificial sequence
  Synthetic oligonucleotide
ggacactgacagtttt

SEQ ID NO: 4262 - DNA, 16 bp, Artificial sequence
  Synthetic oligonucleotide
caggttggacactgac

SEQ ID NO: 4263 - DNA, 16 bp, Artificial sequence
  Synthetic oligonucleotide
taagtacaggttggac

SEQ ID NO: 4264 - DNA, 16 bp, Artificial sequence
  Synthetic oligonucleotide
agttattaagtacagg

SEQ ID NO: 4265 - DNA, 16 bp, Artificial sequence
  Synthetic oligonucleotide
tctgtgagttattaag

SEQ ID NO: 4266 - DNA, 16 bp, Artificial sequence
  Synthetic oligonucleotide
accaaaattctcctga

SEQ ID NO: 4267 - DNA, 16 bp, Artificial sequence
  Synthetic oligonucleotide
acctgaataaccctct

SEQ ID NO: 4268 - DNA, 16 bp, Artificial sequence
  Synthetic oligonucleotide
ggtatcagaaaaagat

SEQ ID NO: 4269 - DNA, 16 bp, Artificial sequence
  Synthetic oligonucleotide
agtattggtatcagaa

SEQ ID NO: 4270 - DNA, 16 bp, Artificial sequence
  Synthetic oligonucleotide
ggaagatactttgaag

SEQ ID NO: 4271 - DNA, 16 bp, Artificial sequence
  Synthetic oligonucleotide
aatgtgggaagatact

SEQ ID NO: 4272 - DNA, 16 bp, Artificial sequence
  Synthetic oligonucleotide
cagataatagctaata

SEQ ID NO: 4273 - DNA, 16 bp, Artificial sequence
  Synthetic oligonucleotide
tcattgcagataatag

SEQ ID NO: 4274 - DNA, 16 bp, Artificial sequence
  Synthetic oligonucleotide
gattcggatttttaaa

SEQ ID NO: 4275 - DNA, 16 bp, Artificial sequence
  Synthetic oligonucleotide
atttgggattcggatt

SEQ ID NO: 4276 - DNA, 16 bp, Artificial sequence
  Synthetic oligonucleotide
acgcttatttgggatt

SEQ ID NO: 4277 - DNA, 16 bp, Artificial sequence
  Synthetic oligonucleotide
tctagagagaaaacgc

SEQ ID NO: 4278 - DNA, 16 bp, Artificial sequence
  Synthetic oligonucleotide
agttaagaggttttcg

SEQ ID NO: 4279 - DNA, 16 bp, Artificial sequence
  Synthetic oligonucleotide
cattatagttaagagg

SEQ ID NO: 4280 - DNA, 16 bp, Artificial sequence
  Synthetic oligonucleotide
cactttcattatagtt

SEQ ID NO: 4281 - DNA, 16 bp, Artificial sequence
  Synthetic oligonucleotide
tagaatgaacactttc

SEQ ID NO: 4282 - DNA, 16 bp, Artificial sequence
  Synthetic oligonucleotide
ttgaactagaatgaac

SEQ ID NO: 4283 - DNA, 16 bp, Artificial sequence
  Synthetic oligonucleotide
acctgattgaactaga

SEQ ID NO: 4284 - DNA, 16 bp, Artificial sequence
  Synthetic oligonucleotide
taaaatacctgattga

SEQ ID NO: 4285 - DNA, 16 bp, Artificial sequence
  Synthetic oligonucleotide
tagaggtaaaatacct

SEQ ID NO: 4286 - DNA, 16 bp, Artificial sequence
  Synthetic oligonucleotide
gaagattagaggtaaa

SEQ ID NO: 4287 - DNA, 16 bp, Artificial sequence
  Synthetic oligonucleotide
tctgaggaagattaga

SEQ ID NO: 4288 - DNA, 16 bp, Artificial sequence
  Synthetic oligonucleotide
tatacactaccaaaaa

SEQ ID NO: 4289 - DNA, 16 bp, Artificial sequence
  Synthetic oligonucleotide
ataatctatacactac

SEQ ID NO: 4290 - DNA, 16 bp, Artificial sequence
  Synthetic oligonucleotide
taagtcccaattttaa

SEQ ID NO: 4291 - DNA, 16 bp, Artificial sequence
  Synthetic oligonucleotide
ccagttttaaataatc

SEQ ID NO: 4292 - DNA, 16 bp, Artificial sequence
  Synthetic oligonucleotide
tgtatcccagttttaa

SEQ ID NO: 4293 - DNA, 16 bp, Artificial sequence
  Synthetic oligonucleotide
gttttagatgcatgta

SEQ ID NO: 4294 - DNA, 16 bp, Artificial sequence
  Synthetic oligonucleotide
tacagtgttttagatg

SEQ ID NO: 4295 - DNA, 16 bp, Artificial sequence
  Synthetic oligonucleotide
ttccccgtaagtttat

SEQ ID NO: 4296 - DNA, 16 bp, Artificial sequence
  Synthetic oligonucleotide
ctgtatttccccgtaa

SEQ ID NO: 4297 - DNA, 16 bp, Artificial sequence
  Synthetic oligonucleotide
tagttactgttactgt

SEQ ID NO: 4298 - DNA, 16 bp, Artificial sequence
  Synthetic oligonucleotide
cgtatgtagttactgt

SEQ ID NO: 4299 - DNA, 16 bp, Artificial sequence
  Synthetic oligonucleotide
aatgggtacagactcg

SEQ ID NO: 4300 - DNA, 16 bp, Artificial sequence
  Synthetic oligonucleotide
gcaatttaatgggtac

SEQ ID NO: 4301 - DNA, 16 bp, Artificial sequence
  Synthetic oligonucleotide
gatagatatgcaattt

SEQ ID NO: 4302 - DNA, 16 bp, Artificial sequence
  Synthetic oligonucleotide
aaaggagatagatatg

SEQ ID NO: 4303 - DNA, 16 bp, Artificial sequence
  Synthetic oligonucleotide
cctcctaaaggagata

SEQ ID NO: 4304 - DNA, 16 bp, Artificial sequence
  Synthetic oligonucleotide
caccagcctcctaaag

SEQ ID NO: 4305 - DNA, 16 bp, Artificial sequence
  Synthetic oligonucleotide
tttgtgatcccaagta

SEQ ID NO: 4306 - DNA, 16 bp, Artificial sequence
  Synthetic oligonucleotide
gctttgtgatcccaag

SEQ ID NO: 4307 - DNA, 16 bp, Artificial sequence
  Synthetic oligonucleotide
ttgctttgtgatccca

SEQ ID NO: 4308 - DNA, 16 bp, Artificial sequence
  Synthetic oligonucleotide
ttttgctttgtgatcc

SEQ ID NO: 4309 - DNA, 16 bp, Artificial sequence
  Synthetic oligonucleotide
ccttttgctttgtgat

SEQ ID NO: 4310 - DNA, 16 bp, Artificial sequence
  Synthetic oligonucleotide
gtccttttgctttgtg

SEQ ID NO: 4311 - DNA, 16 bp, Artificial sequence
  Synthetic oligonucleotide
gtgtccttttgctttg

SEQ ID NO: 4312 - DNA, 16 bp, Artificial sequence
  Synthetic oligonucleotide
gaagtgtccttttgct

SEQ ID NO: 4313 - DNA, 16 bp, Artificial sequence
  Synthetic oligonucleotide
ttgaagtgtccttttg

SEQ ID NO: 4314 - DNA, 16 bp, Artificial sequence
  Synthetic oligonucleotide
agttgaagtgtccttt

SEQ ID NO: 4315 - DNA, 16 bp, Artificial sequence
  Synthetic oligonucleotide
acagttgaagtgtcct

SEQ ID NO: 4316 - DNA, 16 bp, Artificial sequence
  Synthetic oligonucleotide
ggacagttgaagtgtc

SEQ ID NO: 4317 - DNA, 16 bp, Artificial sequence
  Synthetic oligonucleotide
ctggacagttgaagtg

SEQ ID NO: 4318 - DNA, 16 bp, Artificial sequence
  Synthetic oligonucleotide
ctctggacagttgaag

SEQ ID NO: 4319 - DNA, 16 bp, Artificial sequence
  Synthetic oligonucleotide
ccctctggacagttga

SEQ ID NO: 4320 - DNA, 16 bp, Artificial sequence
  Synthetic oligonucleotide
aaccctctggacagtt

SEQ ID NO: 4321 - DNA, 16 bp, Artificial sequence
  Synthetic oligonucleotide
ataaccctctggacag

SEQ ID NO: 4322 - DNA, 16 bp, Artificial sequence
  Synthetic oligonucleotide
gaataaccctctggac

SEQ ID NO: 4323 - DNA, 16 bp, Artificial sequence
  Synthetic oligonucleotide
ctgaataaccctctgg

SEQ ID NO: 4324 - DNA, 16 bp, Artificial sequence
  Synthetic oligonucleotide
tcctgaataaccctct

SEQ ID NO: 4325 - DNA, 16 bp, Artificial sequence
  Synthetic oligonucleotide
cctcctgaataaccct

SEQ ID NO: 4326 - DNA, 16 bp, Artificial sequence
  Synthetic oligonucleotide
accaccagcctcctga

SEQ ID NO: 4327 - DNA, 16 bp, Artificial sequence
  Synthetic oligonucleotide
atgccaccaccagcct

SEQ ID NO: 4328 - DNA, 16 bp, Artificial sequence
  Synthetic oligonucleotide
tcatgccaccaccagc

SEQ ID NO: 4329 - DNA, 16 bp, Artificial sequence
  Synthetic oligonucleotide
catcatgccaccacca

SEQ ID NO: 4330 - DNA, 16 bp, Artificial sequence
  Synthetic oligonucleotide
cactcatcatgccacc

SEQ ID NO: 4331 - DNA, 16 bp, Artificial sequence
  Synthetic oligonucleotide
tccacactcatcatgc

SEQ ID NO: 4332 - DNA, 16 bp, Artificial sequence
  Synthetic oligonucleotide
tctccacactcatcat

SEQ ID NO: 4333 - DNA, 16 bp, Artificial sequence
  Synthetic oligonucleotide
tttctccacactcatc

SEQ ID NO: 4334 - DNA, 16 bp, Artificial sequence
  Synthetic oligonucleotide
gttttctccacactca

SEQ ID NO: 4335 - DNA, 16 bp, Artificial sequence
  Synthetic oligonucleotide
gttgttttctccacac

SEQ ID NO: 4336 - DNA, 16 bp, Artificial sequence
  Synthetic oligonucleotide
aggttgttttctccac

SEQ ID NO: 4337 - DNA, 16 bp, Artificial sequence
  Synthetic oligonucleotide
ttaggttgttttctcc

SEQ ID NO: 4338 - DNA, 16 bp, Artificial sequence
  Synthetic oligonucleotide
taccatttaggttgtt

SEQ ID NO: 4339 - DNA, 16 bp, Artificial sequence
  Synthetic oligonucleotide
tttaccatttaggttg

SEQ ID NO: 4340 - DNA, 16 bp, Artificial sequence
  Synthetic oligonucleotide
tatttaccatttaggt

SEQ ID NO: 4341 - DNA, 16 bp, Artificial sequence
  Synthetic oligonucleotide
ttgttatatttaccat

SEQ ID NO: 4342 - DNA, 16 bp, Artificial sequence
  Synthetic oligonucleotide
gtttgttatatttacc

SEQ ID NO: 4343 - DNA, 16 bp, Artificial sequence
  Synthetic oligonucleotide
cttggtttgttatatt

SEQ ID NO: 4344 - DNA, 16 bp, Artificial sequence
  Synthetic oligonucleotide
ctcttggtttgttata

SEQ ID NO: 4345 - DNA, 16 bp, Artificial sequence
  Synthetic oligonucleotide
tgctcttggtttgtta

SEQ ID NO: 4346 - DNA, 16 bp, Artificial sequence
  Synthetic oligonucleotide
tttgctcttggtttgt

SEQ ID NO: 4347 - DNA, 16 bp, Artificial sequence
  Synthetic oligonucleotide
gattttgctcttggtt

SEQ ID NO: 4348 - DNA, 16 bp, Artificial sequence
  Synthetic oligonucleotide
cttagattttgctctt

SEQ ID NO: 4349 - DNA, 16 bp, Artificial sequence
  Synthetic oligonucleotide
ggcttagattttgctc

SEQ ID NO: 4350 - DNA, 16 bp, Artificial sequence
  Synthetic oligonucleotide
ctggcttagattttgc

SEQ ID NO: 4351 - DNA, 16 bp, Artificial sequence
  Synthetic oligonucleotide
ctctggcttagatttt

SEQ ID NO: 4352 - DNA, 16 bp, Artificial sequence
  Synthetic oligonucleotide
ctctctggcttagatt

SEQ ID NO: 4353 - DNA, 16 bp, Artificial sequence
  Synthetic oligonucleotide
tcctctctggcttaga

SEQ ID NO: 4354 - DNA, 16 bp, Artificial sequence
  Synthetic oligonucleotide
tctcctctctggctta

SEQ ID NO: 4355 - DNA, 16 bp, Artificial sequence
  Synthetic oligonucleotide
taatcctcttctcctc

SEQ ID NO: 4356 - DNA, 16 bp, Artificial sequence
  Synthetic oligonucleotide
gataatcctcttctcc

SEQ ID NO: 4357 - DNA, 16 bp, Artificial sequence
  Synthetic oligonucleotide
aagataatcctcttct

SEQ ID NO: 4358 - DNA, 16 bp, Artificial sequence
  Synthetic oligonucleotide
ccaagataatcctctt

SEQ ID NO: 4359 - DNA, 16 bp, Artificial sequence
  Synthetic oligonucleotide
ttccaagataatcctc

SEQ ID NO: 4360 - DNA, 16 bp, Artificial sequence
  Synthetic oligonucleotide
acttccaagataatcc

SEQ ID NO: 4361 - DNA, 16 bp, Artificial sequence
  Synthetic oligonucleotide
agacttccaagataat

SEQ ID NO: 4362 - DNA, 16 bp, Artificial sequence
  Synthetic oligonucleotide
tgagacttccaagata

SEQ ID NO: 4363 - DNA, 16 bp, Artificial sequence
  Synthetic oligonucleotide
tttgagacttccaaga

SEQ ID NO: 4364 - DNA, 16 bp, Artificial sequence
  Synthetic oligonucleotide
attttgagacttccaa

SEQ ID NO: 4365 - DNA, 16 bp, Artificial sequence
  Synthetic oligonucleotide
ttccattttgagactt

SEQ ID NO: 4366 - DNA, 16 bp, Artificial sequence
  Synthetic oligonucleotide
ccttccattttgagac

SEQ ID NO: 4367 - DNA, 16 bp, Artificial sequence
  Synthetic oligonucleotide
aaccttccattttgag

SEQ ID NO: 4368 - DNA, 16 bp, Artificial sequence
  Synthetic oligonucleotide
ataaccttccattttg

SEQ ID NO: 4369 - DNA, 16 bp, Artificial sequence
  Synthetic oligonucleotide
gtataaccttccattt

SEQ ID NO: 4370 - DNA, 16 bp, Artificial sequence
  Synthetic oligonucleotide
gagtataaccttccat

SEQ ID NO: 4371 - DNA, 16 bp, Artificial sequence
  Synthetic oligonucleotide
tatagagtataacctt

SEQ ID NO: 4372 - DNA, 16 bp, Artificial sequence
  Synthetic oligonucleotide
tttatagagtataacc

SEQ ID NO: 4373 - DNA, 16 bp, Artificial sequence
  Synthetic oligonucleotide
gattttatagagtata

SEQ ID NO: 4374 - DNA, 16 bp, Artificial sequence
  Synthetic oligonucleotide
ttgattttatagagta

SEQ ID NO: 4375 - DNA, 16 bp, Artificial sequence
  Synthetic oligonucleotide
ggttgattttatagag

SEQ ID NO: 4376 - DNA, 16 bp, Artificial sequence
  Synthetic oligonucleotide
ttggttgattttatag

SEQ ID NO: 4377 - DNA, 20 bp, Artificial sequence
  Synthetic oligonucleotide
taatgtttaaattattgcct

SEQ ID NO: 4378 - DNA, 20 bp, Artificial sequence
  Synthetic oligonucleotide
ggttaatgtttaaattattg

SEQ ID NO: 4379 - DNA, 20 bp, Artificial sequence
  Synthetic oligonucleotide
aggttaatgtttaaattatt

SEQ ID NO: 4380 - DNA, 20 bp, Artificial sequence
  Synthetic oligonucleotide
gaggttaatgtttaaattat

SEQ ID NO: 4381 - DNA, 20 bp, Artificial sequence
  Synthetic oligonucleotide
tgaggttaatgtttaaatta

SEQ ID NO: 4382 - DNA, 20 bp, Artificial sequence
  Synthetic oligonucleotide
aatgaggttaatgtttaaat

SEQ ID NO: 4383 - DNA, 20 bp, Artificial sequence
  Synthetic oligonucleotide
gaatgaggttaatgtttaaa

SEQ ID NO: 4384 - DNA, 20 bp, Artificial sequence
  Synthetic oligonucleotide
ggaatgaggttaatgtttaa

SEQ ID NO: 4385 - DNA, 20 bp, Artificial sequence
  Synthetic oligonucleotide
tggaatgaggttaatgttta

SEQ ID NO: 4386 - DNA, 20 bp, Artificial sequence
  Synthetic oligonucleotide
ttggaatgaggttaatgttt

SEQ ID NO: 4387 - DNA, 20 bp, Artificial sequence
  Synthetic oligonucleotide
cttggaatgaggttaatgtt

SEQ ID NO: 4388 - DNA, 20 bp, Artificial sequence
  Synthetic oligonucleotide
taacttggaatgaggttaat

SEQ ID NO: 4389 - DNA, 20 bp, Artificial sequence
  Synthetic oligonucleotide
ttaacttggaatgaggttaa

SEQ ID NO: 4390 - DNA, 20 bp, Artificial sequence
  Synthetic oligonucleotide
attaacttggaatgaggtta

SEQ ID NO: 4391 - DNA, 20 bp, Artificial sequence
  Synthetic oligonucleotide
cattaacttggaatgaggtt

SEQ ID NO: 4392 - DNA, 20 bp, Artificial sequence
  Synthetic oligonucleotide
acattaacttggaatgaggt

SEQ ID NO: 4393 - DNA, 20 bp, Artificial sequence
  Synthetic oligonucleotide
accacattaacttggaatga

SEQ ID NO: 4394 - DNA, 20 bp, Artificial sequence
  Synthetic oligonucleotide
gaccacattaacttggaatg

SEQ ID NO: 4395 - DNA, 20 bp, Artificial sequence
  Synthetic oligonucleotide
agaccacattaacttggaat

SEQ ID NO: 4396 - DNA, 20 bp, Artificial sequence
  Synthetic oligonucleotide
tagaccacattaacttggaa

SEQ ID NO: 4397 - DNA, 20 bp, Artificial sequence
  Synthetic oligonucleotide
ttagaccacattaacttgga

SEQ ID NO: 4398 - DNA, 20 bp, Artificial sequence
  Synthetic oligonucleotide
attagaccacattaacttgg

SEQ ID NO: 4399 - DNA, 20 bp, Artificial sequence
  Synthetic oligonucleotide
tattagaccacattaacttg

SEQ ID NO: 4400 - DNA, 20 bp, Artificial sequence
  Synthetic oligonucleotide
ttattagaccacattaactt

SEQ ID NO: 4401 - DNA, 20 bp, Artificial sequence
  Synthetic oligonucleotide
attattagaccacattaact

SEQ ID NO: 4402 - DNA, 20 bp, Artificial sequence
  Synthetic oligonucleotide
gattattagaccacattaac

SEQ ID NO: 4403 - DNA, 20 bp, Artificial sequence
  Synthetic oligonucleotide
aataccagattattagacca

SEQ ID NO: 4404 - DNA, 20 bp, Artificial sequence
  Synthetic oligonucleotide
taataccagattattagacc

SEQ ID NO: 4405 - DNA, 20 bp, Artificial sequence
  Synthetic oligonucleotide
tttaataccagattattaga

SEQ ID NO: 4406 - DNA, 20 bp, Artificial sequence
  Synthetic oligonucleotide
atttaataccagattattag

SEQ ID NO: 4407 - DNA, 20 bp, Artificial sequence
  Synthetic oligonucleotide
gatttaataccagattatta

SEQ ID NO: 4408 - DNA, 20 bp, Artificial sequence
  Synthetic oligonucleotide
taaggatttaataccagatt

SEQ ID NO: 4409 - DNA, 20 bp, Artificial sequence
  Synthetic oligonucleotide
tttctcttaaggatttaata

SEQ ID NO: 4410 - DNA, 20 bp, Artificial sequence
  Synthetic oligonucleotide
ctttctcttaaggatttaat

SEQ ID NO: 4411 - DNA, 20 bp, Artificial sequence
  Synthetic oligonucleotide
agctttctcttaaggattta

SEQ ID NO: 4412 - DNA, 20 bp, Artificial sequence
  Synthetic oligonucleotide
aagctttctcttaaggattt

SEQ ID NO: 4413 - DNA, 20 bp, Artificial sequence
  Synthetic oligonucleotide
tcaagctttctcttaaggat

SEQ ID NO: 4414 - DNA, 20 bp, Artificial sequence
  Synthetic oligonucleotide
ttctcaagctttctcttaag

SEQ ID NO: 4415 - DNA, 20 bp, Artificial sequence
  Synthetic oligonucleotide
tttctcaagctttctcttaa

SEQ ID NO: 4416 - DNA, 20 bp, Artificial sequence
  Synthetic oligonucleotide
tctatttctcaagctttctc

SEQ ID NO: 4417 - DNA, 20 bp, Artificial sequence
  Synthetic oligonucleotide
atctatttctcaagctttct

SEQ ID NO: 4418 - DNA, 20 bp, Artificial sequence
  Synthetic oligonucleotide
aatctatttctcaagctttc

SEQ ID NO: 4419 - DNA, 20 bp, Artificial sequence
  Synthetic oligonucleotide
aaatctatttctcaagcttt

SEQ ID NO: 4420 - DNA, 20 bp, Artificial sequence
  Synthetic oligonucleotide
aaaatctatttctcaagctt

SEQ ID NO: 4421 - DNA, 20 bp, Artificial sequence
  Synthetic oligonucleotide
gataaaaaaaatctatttct

SEQ ID NO: 4422 - DNA, 20 bp, Artificial sequence
  Synthetic oligonucleotide
tagacagtgactttaagata

SEQ ID NO: 4423 - DNA, 20 bp, Artificial sequence
  Synthetic oligonucleotide
atagacagtgactttaagat

SEQ ID NO: 4424 - DNA, 20 bp, Artificial sequence
  Synthetic oligonucleotide
aatagacagtgactttaaga

SEQ ID NO: 4425 - DNA, 20 bp, Artificial sequence
  Synthetic oligonucleotide
aaatagacagtgactttaag

SEQ ID NO: 4426 - DNA, 20 bp, Artificial sequence
  Synthetic oligonucleotide
taaatagacagtgactttaa

SEQ ID NO: 4427 - DNA, 20 bp, Artificial sequence
  Synthetic oligonucleotide
ttaaatagacagtgacttta

SEQ ID NO: 4428 - DNA, 20 bp, Artificial sequence
  Synthetic oligonucleotide
cttaaatagacagtgacttt

SEQ ID NO: 4429 - DNA, 20 bp, Artificial sequence
  Synthetic oligonucleotide
tcttaaatagacagtgactt

SEQ ID NO: 4430 - DNA, 20 bp, Artificial sequence
  Synthetic oligonucleotide
atcttaaatagacagtgact

SEQ ID NO: 4431 - DNA, 20 bp, Artificial sequence
  Synthetic oligonucleotide
aatcttaaatagacagtgac

SEQ ID NO: 4432 - DNA, 20 bp, Artificial sequence
  Synthetic oligonucleotide
taatcttaaatagacagtga

SEQ ID NO: 4433 - DNA, 20 bp, Artificial sequence
  Synthetic oligonucleotide
ttaatcttaaatagacagtg

SEQ ID NO: 4434 - DNA, 20 bp, Artificial sequence
  Synthetic oligonucleotide
tttaatcttaaatagacagt

SEQ ID NO: 4435 - DNA, 20 bp, Artificial sequence
  Synthetic oligonucleotide
gtttaatcttaaatagacag

SEQ ID NO: 4436 - DNA, 20 bp, Artificial sequence
  Synthetic oligonucleotide
tgtttaatcttaaatagaca

SEQ ID NO: 4437 - DNA, 20 bp, Artificial sequence
  Synthetic oligonucleotide
atgtttaatcttaaatagac

SEQ ID NO: 4438 - DNA, 20 bp, Artificial sequence
  Synthetic oligonucleotide
ttgtatgtttaatcttaaat

SEQ ID NO: 4439 - DNA, 20 bp, Artificial sequence
  Synthetic oligonucleotide
attgtatgtttaatcttaaa

SEQ ID NO: 4440 - DNA, 20 bp, Artificial sequence
  Synthetic oligonucleotide
gattgtatgtttaatcttaa

SEQ ID NO: 4441 - DNA, 20 bp, Artificial sequence
  Synthetic oligonucleotide
tgattgtatgtttaatctta

SEQ ID NO: 4442 - DNA, 20 bp, Artificial sequence
  Synthetic oligonucleotide
tatgtgattgtatgtttaat

SEQ ID NO: 4443 - DNA, 20 bp, Artificial sequence
  Synthetic oligonucleotide
gttatgtgattgtatgttta

SEQ ID NO: 4444 - DNA, 20 bp, Artificial sequence
  Synthetic oligonucleotide
taaggttatgtgattgtatg

SEQ ID NO: 4445 - DNA, 20 bp, Artificial sequence
  Synthetic oligonucleotide
ttaaggttatgtgattgtat

SEQ ID NO: 4446 - DNA, 20 bp, Artificial sequence
  Synthetic oligonucleotide
ttctttaaggttatgtgatt

SEQ ID NO: 4447 - DNA, 16 bp, Artificial sequence
  Synthetic oligonucleotide
gaaatgtaaacggtat

SEQ ID NO: 4448 - DNA, 16 bp, Artificial sequence
  Synthetic oligonucleotide
ttgagaaatgtaaacg

SEQ ID NO: 4449 - DNA, 16 bp, Artificial sequence
  Synthetic oligonucleotide
tgattgagaaatgtaa

SEQ ID NO: 4450 - DNA, 16 bp, Artificial sequence
  Synthetic oligonucleotide
tttgattgagaaatgt

SEQ ID NO: 4451 - DNA, 16 bp, Artificial sequence
  Synthetic oligonucleotide
aagaattttgattgag

SEQ ID NO: 4452 - DNA, 16 bp, Artificial sequence
  Synthetic oligonucleotide
ataagaattttgattg

SEQ ID NO: 4453 - DNA, 16 bp, Artificial sequence
  Synthetic oligonucleotide
caaatagtattataag

SEQ ID NO: 4454 - DNA, 16 bp, Artificial sequence
  Synthetic oligonucleotide
cccacatcacaaaatt

SEQ ID NO: 4455 - DNA, 16 bp, Artificial sequence
  Synthetic oligonucleotide
gattcccacatcacaa

SEQ ID NO: 4456 - DNA, 16 bp, Artificial sequence
  Synthetic oligonucleotide
ttgattcccacatcac

SEQ ID NO: 4457 - DNA, 16 bp, Artificial sequence
  Synthetic oligonucleotide
aattgattcccacatc

SEQ ID NO: 4458 - DNA, 16 bp, Artificial sequence
  Synthetic oligonucleotide
aaaattgattcccaca

SEQ ID NO: 4459 - DNA, 16 bp, Artificial sequence
  Synthetic oligonucleotide
ctaaaattgattccca

SEQ ID NO: 4460 - DNA, 16 bp, Artificial sequence
  Synthetic oligonucleotide
catctaaaattgattc

SEQ ID NO: 4461 - DNA, 16 bp, Artificial sequence
  Synthetic oligonucleotide
accatctaaaattgat

SEQ ID NO: 4462 - DNA, 16 bp, Artificial sequence
  Synthetic oligonucleotide
tgaccatctaaaattg

SEQ ID NO: 4463 - DNA, 16 bp, Artificial sequence
  Synthetic oligonucleotide
tgtgaccatctaaaat

SEQ ID NO: 4464 - DNA, 16 bp, Artificial sequence
  Synthetic oligonucleotide
attgtgaccatctaaa

SEQ ID NO: 4465 - DNA, 16 bp, Artificial sequence
  Synthetic oligonucleotide
agattgtgaccatcta

SEQ ID NO: 4466 - DNA, 16 bp, Artificial sequence
  Synthetic oligonucleotide
ctagattgtgaccatc

SEQ ID NO: 4467 - DNA, 16 bp, Artificial sequence
  Synthetic oligonucleotide
atctagattgtgacca

SEQ ID NO: 4468 - DNA, 16 bp, Artificial sequence
  Synthetic oligonucleotide
taatctagattgtgac

SEQ ID NO: 4469 - DNA, 16 bp, Artificial sequence
  Synthetic oligonucleotide
tataatctagattgtg

SEQ ID NO: 4470 - DNA, 16 bp, Artificial sequence
  Synthetic oligonucleotide
attataatctagattg

SEQ ID NO: 4471 - DNA, 16 bp, Artificial sequence
  Synthetic oligonucleotide
tgattataatctagat

SEQ ID NO: 4472 - DNA, 16 bp, Artificial sequence
  Synthetic oligonucleotide
attgattataatctag

SEQ ID NO: 4473 - DNA, 16 bp, Artificial sequence
  Synthetic oligonucleotide
ctattgattataatct

SEQ ID NO: 4474 - DNA, 16 bp, Artificial sequence
  Synthetic oligonucleotide
acctattgattataat

SEQ ID NO: 4475 - DNA, 16 bp, Artificial sequence
  Synthetic oligonucleotide
tcacctattgattata

SEQ ID NO: 4476 - DNA, 16 bp, Artificial sequence
  Synthetic oligonucleotide
gttcacctattgatta

SEQ ID NO: 4477 - DNA, 16 bp, Artificial sequence
  Synthetic oligonucleotide
aagttcacctattgat

SEQ ID NO: 4478 - DNA, 16 bp, Artificial sequence
  Synthetic oligonucleotide
ataagttcacctattg

SEQ ID NO: 4479 - DNA, 16 bp, Artificial sequence
  Synthetic oligonucleotide
taataagttcacctat

SEQ ID NO: 4480 - DNA, 16 bp, Artificial sequence
  Synthetic oligonucleotide
tttaataagttcacct

SEQ ID NO: 4481 - DNA, 16 bp, Artificial sequence
  Synthetic oligonucleotide
tatttaataagttcac

SEQ ID NO: 4482 - DNA, 16 bp, Artificial sequence
  Synthetic oligonucleotide
gttatttaataagttc

SEQ ID NO: 4483 - DNA, 16 bp, Artificial sequence
  Synthetic oligonucleotide
catatgatgcctttta

SEQ ID NO: 4484 - DNA, 16 bp, Artificial sequence
  Synthetic oligonucleotide
tattagctcatatgat

SEQ ID NO: 4485 - DNA, 16 bp, Artificial sequence
  Synthetic oligonucleotide
gatattagctcatatg

SEQ ID NO: 4486 - DNA, 16 bp, Artificial sequence
  Synthetic oligonucleotide
gtgatattagctcata

SEQ ID NO: 4487 - DNA, 16 bp, Artificial sequence
  Synthetic oligonucleotide
agttgtgatattagct

SEQ ID NO: 4488 - DNA, 16 bp, Artificial sequence
  Synthetic oligonucleotide
aaagttgtgatattag

SEQ ID NO: 4489 - DNA, 16 bp, Artificial sequence
  Synthetic oligonucleotide
ggaaagttgtgatatt

SEQ ID NO: 4490 - DNA, 16 bp, Artificial sequence
  Synthetic oligonucleotide
tgggaaagttgtgata

SEQ ID NO: 4491 - DNA, 16 bp, Artificial sequence
  Synthetic oligonucleotide
aaactgggaaagttgt

SEQ ID NO: 4492 - DNA, 16 bp, Artificial sequence
  Synthetic oligonucleotide
ttaaactgggaaagtt

SEQ ID NO: 4493 - DNA, 16 bp, Artificial sequence
  Synthetic oligonucleotide
gttttttaaactggga

SEQ ID NO: 4494 - DNA, 16 bp, Artificial sequence
  Synthetic oligonucleotide
tagttttttaaactgg

SEQ ID NO: 4495 - DNA, 16 bp, Artificial sequence
  Synthetic oligonucleotide
gagtactagtttttta

SEQ ID NO: 4496 - DNA, 16 bp, Artificial sequence
  Synthetic oligonucleotide
aagagtactagttttt

SEQ ID NO: 4497 - DNA, 16 bp, Artificial sequence
  Synthetic oligonucleotide
acaagagtactagttt

SEQ ID NO: 4498 - DNA, 16 bp, Artificial sequence
  Synthetic oligonucleotide
taacaagagtactagt

SEQ ID NO: 4499 - DNA, 16 bp, Artificial sequence
  Synthetic oligonucleotide
tttaacaagagtacta

SEQ ID NO: 4500 - DNA, 16 bp, Artificial sequence
  Synthetic oligonucleotide
gttttaacaagagtac

SEQ ID NO: 4501 - DNA, 16 bp, Artificial sequence
  Synthetic oligonucleotide
gagttttaacaagagt

SEQ ID NO: 4502 - DNA, 16 bp, Artificial sequence
  Synthetic oligonucleotide
tagagttttaacaaga

SEQ ID NO: 4503 - DNA, 16 bp, Artificial sequence
  Synthetic oligonucleotide
gtttagagttttaaca

SEQ ID NO: 4504 - DNA, 16 bp, Artificial sequence
  Synthetic oligonucleotide
caagtttagagtttta

SEQ ID NO: 4505 - DNA, 16 bp, Artificial sequence
  Synthetic oligonucleotide
gtcaagtttagagttt

SEQ ID NO: 4506 - DNA, 16 bp, Artificial sequence
  Synthetic oligonucleotide
tagtcaagtttagagt

SEQ ID NO: 4507 - DNA, 16 bp, Artificial sequence
  Synthetic oligonucleotide
tttagtcaagtttaga

SEQ ID NO: 4508 - DNA, 16 bp, Artificial sequence
  Synthetic oligonucleotide
tatttagtcaagttta

SEQ ID NO: 4509 - DNA, 16 bp, Artificial sequence
  Synthetic oligonucleotide
tgtatttagtcaagtt

SEQ ID NO: 4510 - DNA, 16 bp, Artificial sequence
  Synthetic oligonucleotide
tctgtatttagtcaag

SEQ ID NO: 4511 - DNA, 16 bp, Artificial sequence
  Synthetic oligonucleotide
cctctgtatttagtca

SEQ ID NO: 4512 - DNA, 16 bp, Artificial sequence
  Synthetic oligonucleotide
gtcctctgtatttagt

SEQ ID NO: 4513 - DNA, 16 bp, Artificial sequence
  Synthetic oligonucleotide
cagtcctctgtattta

SEQ ID NO: 4514 - DNA, 16 bp, Artificial sequence
  Synthetic oligonucleotide
accagtcctctgtatt

SEQ ID NO: 4515 - DNA, 16 bp, Artificial sequence
  Synthetic oligonucleotide
ttaccagtcctctgta

SEQ ID NO: 4516 - DNA, 16 bp, Artificial sequence
  Synthetic oligonucleotide
aattaccagtcctctg

SEQ ID NO: 4517 - DNA, 16 bp, Artificial sequence
  Synthetic oligonucleotide
acaattaccagtcctc

SEQ ID NO: 4518 - DNA, 16 bp, Artificial sequence
  Synthetic oligonucleotide
gcaaattttcagtgtt

SEQ ID NO: 4519 - DNA, 16 bp, Artificial sequence
  Synthetic oligonucleotide
cgatttgtaattttca

SEQ ID NO: 4520 - DNA, 16 bp, Artificial sequence
  Synthetic oligonucleotide
tttaaccgatttgtaa

SEQ ID NO: 4521 - DNA, 16 bp, Artificial sequence
  Synthetic oligonucleotide
gtataatttaaccgat

SEQ ID NO: 4522 - DNA, 16 bp, Artificial sequence
  Synthetic oligonucleotide
ctagattgtataattt

SEQ ID NO: 4523 - DNA, 16 bp, Artificial sequence
  Synthetic oligonucleotide
agtgttctagattgta

SEQ ID NO: 4524 - DNA, 16 bp, Artificial sequence
  Synthetic oligonucleotide
tgacatagtgttctag

SEQ ID NO: 4525 - DNA, 16 bp, Artificial sequence
  Synthetic oligonucleotide
gtgtaatgacatagtg

SEQ ID NO: 4526 - DNA, 16 bp, Artificial sequence
  Synthetic oligonucleotide
acaatagtgtaatgac

SEQ ID NO: 4527 - DNA, 16 bp, Artificial sequence
  Synthetic oligonucleotide
gtaatttacaatagtg

SEQ ID NO: 4528 - DNA, 16 bp, Artificial sequence
  Synthetic oligonucleotide
ccttcagtaatttaca

SEQ ID NO: 4529 - DNA, 16 bp, Artificial sequence
  Synthetic oligonucleotide
tacttaccttcagtaa

SEQ ID NO: 4530 - DNA, 16 bp, Artificial sequence
  Synthetic oligonucleotide
ctggagaatagtttta

SEQ ID NO: 4531 - DNA, 16 bp, Artificial sequence
  Synthetic oligonucleotide
ttaaacactggagaat

SEQ ID NO: 4532 - DNA, 16 bp, Artificial sequence
  Synthetic oligonucleotide
gcccagcatattttca

SEQ ID NO: 4533 - DNA, 16 bp, Artificial sequence
  Synthetic oligonucleotide
gaaaaagcccagcata

SEQ ID NO: 4534 - DNA, 16 bp, Artificial sequence
  Synthetic oligonucleotide
gattttctgaacttca

SEQ ID NO: 4535 - DNA, 16 bp, Artificial sequence
  Synthetic oligonucleotide
gtactatctctaaaat

SEQ ID NO: 4536 - DNA, 16 bp, Artificial sequence
  Synthetic oligonucleotide
taaattgtactatctc

SEQ ID NO: 4537 - DNA, 16 bp, Artificial sequence
  Synthetic oligonucleotide
cacatatttttgtcct

SEQ ID NO: 4538 - DNA, 16 bp, Artificial sequence
  Synthetic oligonucleotide
ctttcaaatagcacat

SEQ ID NO: 4539 - DNA, 16 bp, Artificial sequence
  Synthetic oligonucleotide
gtatgcttctttcaaa

SEQ ID NO: 4540 - DNA, 16 bp, Artificial sequence
  Synthetic oligonucleotide
ccccttgtatgcttct

SEQ ID NO: 4541 - DNA, 16 bp, Artificial sequence
  Synthetic oligonucleotide
ttccttccccttgtat

SEQ ID NO: 4542 - DNA, 16 bp, Artificial sequence
  Synthetic oligonucleotide
tggcaattccttcccc

SEQ ID NO: 4543 - DNA, 16 bp, Artificial sequence
  Synthetic oligonucleotide
gaatattggcaattcc

SEQ ID NO: 4544 - DNA, 16 bp, Artificial sequence
  Synthetic oligonucleotide
ctaataatggatttga

SEQ ID NO: 4545 - DNA, 16 bp, Artificial sequence
  Synthetic oligonucleotide
ctatcataatctaaat

SEQ ID NO: 4546 - DNA, 16 bp, Artificial sequence
  Synthetic oligonucleotide
gtaacactatcataat

SEQ ID NO: 4547 - DNA, 16 bp, Artificial sequence
  Synthetic oligonucleotide
aatttcctgtaacact

SEQ ID NO: 4548 - DNA, 16 bp, Artificial sequence
  Synthetic oligonucleotide
aagttgctttcctctt

SEQ ID NO: 4549 - DNA, 16 bp, Artificial sequence
  Synthetic oligonucleotide
ggttataagttgcttt

SEQ ID NO: 4550 - DNA, 16 bp, Artificial sequence
  Synthetic oligonucleotide
taggttggttataagt

SEQ ID NO: 4551 - DNA, 16 bp, Artificial sequence
  Synthetic oligonucleotide
agagagtaggttggtt

SEQ ID NO: 4552 - DNA, 16 bp, Artificial sequence
  Synthetic oligonucleotide
ggatatagagagtagg

SEQ ID NO: 4553 - DNA, 16 bp, Artificial sequence
  Synthetic oligonucleotide
aagtctggatatagag

SEQ ID NO: 4554 - DNA, 16 bp, Artificial sequence
  Synthetic oligonucleotide
ctacaaaagtctggat

SEQ ID NO: 4555 - DNA, 16 bp, Artificial sequence
  Synthetic oligonucleotide
cttacctgattttcta

SEQ ID NO: 4556 - DNA, 16 bp, Artificial sequence
  Synthetic oligonucleotide
tactgacttacctgat

SEQ ID NO: 4557 - DNA, 16 bp, Artificial sequence
  Synthetic oligonucleotide
ccattaaaatactgac

SEQ ID NO: 4558 - DNA, 16 bp, Artificial sequence
  Synthetic oligonucleotide
ggacataccattaaaa

SEQ ID NO: 4559 - DNA, 16 bp, Artificial sequence
  Synthetic oligonucleotide
aagatgggacatacca

SEQ ID NO: 4560 - DNA, 16 bp, Artificial sequence
  Synthetic oligonucleotide
gtgtgaaagatgggac

SEQ ID NO: 4561 - DNA, 16 bp, Artificial sequence
  Synthetic oligonucleotide
agacctgtgtgaaaga

SEQ ID NO: 4562 - DNA, 16 bp, Artificial sequence
  Synthetic oligonucleotide
ttttacagacctgtgt

SEQ ID NO: 4563 - DNA, 16 bp, Artificial sequence
  Synthetic oligonucleotide
cagtgtttttacagac

SEQ ID NO: 4564 - DNA, 16 bp, Artificial sequence
  Synthetic oligonucleotide
taggattcagtgtttt

SEQ ID NO: 4565 - DNA, 16 bp, Artificial sequence
  Synthetic oligonucleotide
gttaaagcttgtaaat

SEQ ID NO: 4566 - DNA, 16 bp, Artificial sequence
  Synthetic oligonucleotide
gatccagttaaagctt

SEQ ID NO: 4567 - DNA, 16 bp, Artificial sequence
  Synthetic oligonucleotide
actcatgatccagtta

SEQ ID NO: 4568 - DNA, 16 bp, Artificial sequence
  Synthetic oligonucleotide
aattttactcatgatc

SEQ ID NO: 4569 - DNA, 16 bp, Artificial sequence
  Synthetic oligonucleotide
tgtgataattttactc

SEQ ID NO: 4570 - DNA, 16 bp, Artificial sequence
  Synthetic oligonucleotide
tgctgatgtgataatt

SEQ ID NO: 4571 - DNA, 16 bp, Artificial sequence
  Synthetic oligonucleotide
gcaattttaacagtta

SEQ ID NO: 4572 - DNA, 16 bp, Artificial sequence
  Synthetic oligonucleotide
gagcctgcaattttaa

SEQ ID NO: 4573 - DNA, 16 bp, Artificial sequence
  Synthetic oligonucleotide
tagcttcagagcctgc

SEQ ID NO: 4574 - DNA, 16 bp, Artificial sequence
  Synthetic oligonucleotide
gtttattagcttcaga

SEQ ID NO: 4575 - DNA, 16 bp, Artificial sequence
  Synthetic oligonucleotide
caggtagtttattagc

SEQ ID NO: 4576 - DNA, 16 bp, Artificial sequence
  Synthetic oligonucleotide
taaatgcaggtagttt

SEQ ID NO: 4577 - DNA, 16 bp, Artificial sequence
  Synthetic oligonucleotide
atggtttaaatgcagg

SEQ ID NO: 4578 - DNA, 16 bp, Artificial sequence
  Synthetic oligonucleotide
tagagccatggtttaa

SEQ ID NO: 4579 - DNA, 16 bp, Artificial sequence
  Synthetic oligonucleotide
tcacacaaagttttag

SEQ ID NO: 4580 - DNA, 16 bp, Artificial sequence
  Synthetic oligonucleotide
gtgaagtaatttattc

SEQ ID NO: 4581 - DNA, 16 bp, Artificial sequence
  Synthetic oligonucleotide
actgagagataaaggg

SEQ ID NO: 4582 - DNA, 16 bp, Artificial sequence
  Synthetic oligonucleotide
gtatatgtgaggaaac

SEQ ID NO: 4583 - DNA, 16 bp, Artificial sequence
  Synthetic oligonucleotide
tttgtagtatatgtga

SEQ ID NO: 4584 - DNA, 16 bp, Artificial sequence
  Synthetic oligonucleotide
attatctttgtagtat

SEQ ID NO: 4585 - DNA, 16 bp, Artificial sequence
  Synthetic oligonucleotide
ataagttctgttatta

SEQ ID NO: 4586 - DNA, 16 bp, Artificial sequence
  Synthetic oligonucleotide
aatcctataagttctg

SEQ ID NO: 4587 - DNA, 16 bp, Artificial sequence
  Synthetic oligonucleotide
ctgctatgaattaatt

SEQ ID NO: 4588 - DNA, 16 bp, Artificial sequence
  Synthetic oligonucleotide
cattggctgctatgaa

SEQ ID NO: 4589 - DNA, 16 bp, Artificial sequence
  Synthetic oligonucleotide
agatgacattggctgc

SEQ ID NO: 4590 - DNA, 16 bp, Artificial sequence
  Synthetic oligonucleotide
ttagtaagatgacatt

SEQ ID NO: 4591 - DNA, 16 bp, Artificial sequence
  Synthetic oligonucleotide
gatctaatttgaattt

SEQ ID NO: 4592 - DNA, 16 bp, Artificial sequence
  Synthetic oligonucleotide
ttgagcaaagagaaac

SEQ ID NO: 4593 - DNA, 16 bp, Artificial sequence
  Synthetic oligonucleotide
gaatgttgacctttaa

SEQ ID NO: 4594 - DNA, 16 bp, Artificial sequence
  Synthetic oligonucleotide
attgttgaatgttgac

SEQ ID NO: 4595 - DNA, 16 bp, Artificial sequence
  Synthetic oligonucleotide
ttaattacattgttga

SEQ ID NO: 4596 - DNA, 16 bp, Artificial sequence
  Synthetic oligonucleotide
ttgtagattaattaca

SEQ ID NO: 4597 - DNA, 16 bp, Artificial sequence
  Synthetic oligonucleotide
tttacattgtagatta

SEQ ID NO: 4598 - DNA, 16 bp, Artificial sequence
  Synthetic oligonucleotide
cagatgtttacattgt

SEQ ID NO: 4599 - DNA, 16 bp, Artificial sequence
  Synthetic oligonucleotide
cttcaccagatgttta

SEQ ID NO: 4600 - DNA, 16 bp, Artificial sequence
  Synthetic oligonucleotide
agtgcttccctctgtc

SEQ ID NO: 4601 - DNA, 16 bp, Artificial sequence
  Synthetic oligonucleotide
taaacaagtgcttccc

SEQ ID NO: 4602 - DNA, 16 bp, Artificial sequence
  Synthetic oligonucleotide
tagcttttttctaaac

SEQ ID NO: 4603 - DNA, 16 bp, Artificial sequence
  Synthetic oligonucleotide
ctgacatagctttttt

SEQ ID NO: 4604 - DNA, 16 bp, Artificial sequence
  Synthetic oligonucleotide
aatacatggattctga

SEQ ID NO: 4605 - DNA, 16 bp, Artificial sequence
  Synthetic oligonucleotide
tattagaatacatgga

SEQ ID NO: 4606 - DNA, 16 bp, Artificial sequence
  Synthetic oligonucleotide
gtactgcatattagaa

SEQ ID NO: 4607 - DNA, 16 bp, Artificial sequence
  Synthetic oligonucleotide
actattgtactgcata

SEQ ID NO: 4608 - DNA, 16 bp, Artificial sequence
  Synthetic oligonucleotide
ttttaaactattgtac

SEQ ID NO: 4609 - DNA, 16 bp, Artificial sequence
  Synthetic oligonucleotide
gagagtattattaata

SEQ ID NO: 4610 - DNA, 16 bp, Artificial sequence
  Synthetic oligonucleotide
ctgtttgagagtatta

SEQ ID NO: 4611 - DNA, 16 bp, Artificial sequence
  Synthetic oligonucleotide
gaatagctgtttgaga

SEQ ID NO: 4612 - DNA, 16 bp, Artificial sequence
  Synthetic oligonucleotide
aatcctcttgaatagc

SEQ ID NO: 4613 - DNA, 16 bp, Artificial sequence
  Synthetic oligonucleotide
tttttgaatcctcttg

SEQ ID NO: 4614 - DNA, 16 bp, Artificial sequence
  Synthetic oligonucleotide
gagtttatattatgtt

SEQ ID NO: 4615 - DNA, 16 bp, Artificial sequence
  Synthetic oligonucleotide
gtttctctgagtttat

SEQ ID NO: 4616 - DNA, 16 bp, Artificial sequence
  Synthetic oligonucleotide
ttaccagtttctctga

SEQ ID NO: 4617 - DNA, 16 bp, Artificial sequence
  Synthetic oligonucleotide
gattttgtttaccagt

SEQ ID NO: 4618 - DNA, 16 bp, Artificial sequence
  Synthetic oligonucleotide
gttttatatctcttga

SEQ ID NO: 4619 - DNA, 16 bp, Artificial sequence
  Synthetic oligonucleotide
ttggtaataatatttg

SEQ ID NO: 4620 - DNA, 16 bp, Artificial sequence
  Synthetic oligonucleotide
tggaaattggtaataa

SEQ ID NO: 4621 - DNA, 16 bp, Artificial sequence
  Synthetic oligonucleotide
gtttagtggaaattgg

SEQ ID NO: 4622 - DNA, 16 bp, Artificial sequence
  Synthetic oligonucleotide
atgtttgtttagtgga

SEQ ID NO: 4623 - DNA, 16 bp, Artificial sequence
  Synthetic oligonucleotide
ctaacattatgtttgt

SEQ ID NO: 4624 - DNA, 16 bp, Artificial sequence
  Synthetic oligonucleotide
gcactactaacattat

SEQ ID NO: 4625 - DNA, 16 bp, Artificial sequence
  Synthetic oligonucleotide
ttagcagcactactaa

SEQ ID NO: 4626 - DNA, 16 bp, Artificial sequence
  Synthetic oligonucleotide
ttgataaaaaaccttt

SEQ ID NO: 4627 - DNA, 16 bp, Artificial sequence
  Synthetic oligonucleotide
caaaagtagttgataa

SEQ ID NO: 4628 - DNA, 16 bp, Artificial sequence
  Synthetic oligonucleotide
ggaaaccaaaagtagt

SEQ ID NO: 4629 - DNA, 16 bp, Artificial sequence
  Synthetic oligonucleotide
gaaagtatggaaacca

SEQ ID NO: 4630 - DNA, 16 bp, Artificial sequence
  Synthetic oligonucleotide
acatcataagaaggaa

SEQ ID NO: 4631 - DNA, 16 bp, Artificial sequence
  Synthetic oligonucleotide
tcatagtaaaagatat

SEQ ID NO: 4632 - DNA, 16 bp, Artificial sequence
  Synthetic oligonucleotide
tcatttaatcatagta

SEQ ID NO: 4633 - DNA, 16 bp, Artificial sequence
  Synthetic oligonucleotide
gcaggttcatttaatc

SEQ ID NO: 4634 - DNA, 16 bp, Artificial sequence
  Synthetic oligonucleotide
gtaacattttgctttg

SEQ ID NO: 4635 - DNA, 16 bp, Artificial sequence
  Synthetic oligonucleotide
atattactatagtaac

SEQ ID NO: 4636 - DNA, 16 bp, Artificial sequence
  Synthetic oligonucleotide
caatgtatattactat

SEQ ID NO: 4637 - DNA, 16 bp, Artificial sequence
  Synthetic oligonucleotide
tagacacaatgtatat

SEQ ID NO: 4638 - DNA, 16 bp, Artificial sequence
  Synthetic oligonucleotide
ggtttcttcacacatt

SEQ ID NO: 4639 - DNA, 16 bp, Artificial sequence
  Synthetic oligonucleotide
ctcagaaattcattgt

SEQ ID NO: 4640 - DNA, 16 bp, Artificial sequence
  Synthetic oligonucleotide
cttcttccaactcaga

SEQ ID NO: 4641 - DNA, 16 bp, Artificial sequence
  Synthetic oligonucleotide
ctaactcttcttccaa

SEQ ID NO: 4642 - DNA, 16 bp, Artificial sequence
  Synthetic oligonucleotide
aatgatctaactcttc

SEQ ID NO: 4643 - DNA, 16 bp, Artificial sequence
  Synthetic oligonucleotide
gaaagttaaatgatct

SEQ ID NO: 4644 - DNA, 16 bp, Artificial sequence
  Synthetic oligonucleotide
atcttaaagttactta

SEQ ID NO: 4645 - DNA, 16 bp, Artificial sequence
  Synthetic oligonucleotide
tatgtgatcttaaagt

SEQ ID NO: 4646 - DNA, 16 bp, Artificial sequence
  Synthetic oligonucleotide
agtaactatgtgatct

SEQ ID NO: 4647 - DNA, 16 bp, Artificial sequence
  Synthetic oligonucleotide
ctactaagtaactatg

SEQ ID NO: 4648 - DNA, 16 bp, Artificial sequence
  Synthetic oligonucleotide
tcttttctactaagta

SEQ ID NO: 4649 - DNA, 16 bp, Artificial sequence
  Synthetic oligonucleotide
tattactcttttctac

SEQ ID NO: 4650 - DNA, 16 bp, Artificial sequence
  Synthetic oligonucleotide
gctgggtattactctt

SEQ ID NO: 4651 - DNA, 16 bp, Artificial sequence
  Synthetic oligonucleotide
taaagtttgcttgctg

SEQ ID NO: 4652 - DNA, 16 bp, Artificial sequence
  Synthetic oligonucleotide
ctattgtaaagtttgc

SEQ ID NO: 4653 - DNA, 16 bp, Artificial sequence
  Synthetic oligonucleotide
aaggatctattgtaaa

SEQ ID NO: 4654 - DNA, 16 bp, Artificial sequence
  Synthetic oligonucleotide
cttatttaaaaggatc

SEQ ID NO: 4655 - DNA, 16 bp, Artificial sequence
  Synthetic oligonucleotide
taggaccttatttaaa

SEQ ID NO: 4656 - DNA, 16 bp, Artificial sequence
  Synthetic oligonucleotide
atttcctaggacctta

SEQ ID NO: 4657 - DNA, 16 bp, Artificial sequence
  Synthetic oligonucleotide
catgaatgatatttcc

SEQ ID NO: 4658 - DNA, 16 bp, Artificial sequence
  Synthetic oligonucleotide
tgctggcatgaatgat

SEQ ID NO: 4659 - DNA, 16 bp, Artificial sequence
  Synthetic oligonucleotide
ttttgatgctggcatg

SEQ ID NO: 4660 - DNA, 16 bp, Artificial sequence
  Synthetic oligonucleotide
ttagttttttgatgct

SEQ ID NO: 4661 - DNA, 16 bp, Artificial sequence
  Synthetic oligonucleotide
gcattattagtgttag

SEQ ID NO: 4662 - DNA, 16 bp, Artificial sequence
  Synthetic oligonucleotide
tatcttgcattattag

SEQ ID NO: 4663 - DNA, 16 bp, Artificial sequence
  Synthetic oligonucleotide
atataatatcttgcat

SEQ ID NO: 4664 - DNA, 16 bp, Artificial sequence
  Synthetic oligonucleotide
cattgacagtaagaaa

SEQ ID NO: 4665 - DNA, 16 bp, Artificial sequence
  Synthetic oligonucleotide
agtttttctcattgac

SEQ ID NO: 4666 - DNA, 16 bp, Artificial sequence
  Synthetic oligonucleotide
atggatatctcttaac

SEQ ID NO: 4667 - DNA, 16 bp, Artificial sequence
  Synthetic oligonucleotide
tatttgatggatatct

SEQ ID NO: 4668 - DNA, 16 bp, Artificial sequence
  Synthetic oligonucleotide
acattgtatttgatgg

SEQ ID NO: 4669 - DNA, 16 bp, Artificial sequence
  Synthetic oligonucleotide
gttgatacattgtatt

SEQ ID NO: 4670 - DNA, 16 bp, Artificial sequence
  Synthetic oligonucleotide
gtttaggttgatacat

SEQ ID NO: 4671 - DNA, 16 bp, Artificial sequence
  Synthetic oligonucleotide
catccagtttaggttg

SEQ ID NO: 4672 - DNA, 16 bp, Artificial sequence
  Synthetic oligonucleotide
ccccagcatccagttt

SEQ ID NO: 4673 - DNA, 16 bp, Artificial sequence
  Synthetic oligonucleotide
aaagaaccccagcatc

SEQ ID NO: 4674 - DNA, 16 bp, Artificial sequence
  Synthetic oligonucleotide
gtgtaaaaagaacccc

SEQ ID NO: 4675 - DNA, 16 bp, Artificial sequence
  Synthetic oligonucleotide
tatagggtgtaaaaag

SEQ ID NO: 4676 - DNA, 16 bp, Artificial sequence
  Synthetic oligonucleotide
aggtatgtcttttata

SEQ ID NO: 4677 - DNA, 16 bp, Artificial sequence
  Synthetic oligonucleotide
agtccatatttgtatt

SEQ ID NO: 4678 - DNA, 16 bp, Artificial sequence
  Synthetic oligonucleotide
taatcaagtccatatt

SEQ ID NO: 4679 - DNA, 16 bp, Artificial sequence
  Synthetic oligonucleotide
atctaataatcaagtc

SEQ ID NO: 4680 - DNA, 16 bp, Artificial sequence
  Synthetic oligonucleotide
ccttctatattatcta

SEQ ID NO: 4681 - DNA, 16 bp, Artificial sequence
  Synthetic oligonucleotide
taataaaccttctata

SEQ ID NO: 4682 - DNA, 16 bp, Artificial sequence
  Synthetic oligonucleotide
gatcacatctaagaaa

SEQ ID NO: 4683 - DNA, 16 bp, Artificial sequence
  Synthetic oligonucleotide
taccatgatcacatct

SEQ ID NO: 4684 - DNA, 16 bp, Artificial sequence
  Synthetic oligonucleotide
ctgcaataccatgatc

SEQ ID NO: 4685 - DNA, 16 bp, Artificial sequence
  Synthetic oligonucleotide
gttctcctttaaaact

SEQ ID NO: 4686 - DNA, 16 bp, Artificial sequence
  Synthetic oligonucleotide
gagattgttctccttt

SEQ ID NO: 4687 - DNA, 16 bp, Artificial sequence
  Synthetic oligonucleotide
aaacaggagattgttc

SEQ ID NO: 4688 - DNA, 16 bp, Artificial sequence
  Synthetic oligonucleotide
tctcttaaacaggaga

SEQ ID NO: 4689 - DNA, 16 bp, Artificial sequence
  Synthetic oligonucleotide
catgtatctcttaaac

SEQ ID NO: 4690 - DNA, 16 bp, Artificial sequence
  Synthetic oligonucleotide
cgtaaatatttcagca

SEQ ID NO: 4691 - DNA, 16 bp, Artificial sequence
  Synthetic oligonucleotide
taactccgtaaatatt

SEQ ID NO: 4692 - DNA, 16 bp, Artificial sequence
  Synthetic oligonucleotide
gacctttaactccgta

SEQ ID NO: 4693 - DNA, 16 bp, Artificial sequence
  Synthetic oligonucleotide
tccagtgacctttaac

SEQ ID NO: 4694 - DNA, 16 bp, Artificial sequence
  Synthetic oligonucleotide
caccagtctggagtcc

SEQ ID NO: 4695 - DNA, 16 bp, Artificial sequence
  Synthetic oligonucleotide
ttctatcaccagtctg

SEQ ID NO: 4696 - DNA, 16 bp, Artificial sequence
  Synthetic oligonucleotide
atcttaccaaactatt

SEQ ID NO: 4697 - DNA, 16 bp, Artificial sequence
  Synthetic oligonucleotide
agaatcatcttaccaa

SEQ ID NO: 4698 - DNA, 16 bp, Artificial sequence
  Synthetic oligonucleotide
gaatgtaagaatcatc

SEQ ID NO: 4699 - DNA, 16 bp, Artificial sequence
  Synthetic oligonucleotide
gtgttatttaagaatg

SEQ ID NO: 4700 - DNA, 16 bp, Artificial sequence
  Synthetic oligonucleotide
gtttatgttaaagcat

SEQ ID NO: 4701 - DNA, 16 bp, Artificial sequence
  Synthetic oligonucleotide
agtaatgtttatgtta

SEQ ID NO: 4702 - DNA, 16 bp, Artificial sequence
  Synthetic oligonucleotide
gtagcattttttcagt

SEQ ID NO: 4703 - DNA, 16 bp, Artificial sequence
  Synthetic oligonucleotide
gcaaatgtagcatttt

SEQ ID NO: 4704 - DNA, 16 bp, Artificial sequence
  Synthetic oligonucleotide
gttgtggcaaatgtag

SEQ ID NO: 4705 - DNA, 16 bp, Artificial sequence
  Synthetic oligonucleotide
tatgaagttgtggcaa

SEQ ID NO: 4706 - DNA, 16 bp, Artificial sequence
  Synthetic oligonucleotide
gatttcacttgacatt

SEQ ID NO: 4707 - DNA, 16 bp, Artificial sequence
  Synthetic oligonucleotide
gcttgagatttcactt

SEQ ID NO: 4708 - DNA, 16 bp, Artificial sequence
  Synthetic oligonucleotide
tttggagcttgagatt

SEQ ID NO: 4709 - DNA, 16 bp, Artificial sequence
  Synthetic oligonucleotide
aatatctttggagctt

SEQ ID NO: 4710 - DNA, 16 bp, Artificial sequence
  Synthetic oligonucleotide
aggaataatatctttg

SEQ ID NO: 4711 - DNA, 16 bp, Artificial sequence
  Synthetic oligonucleotide
atttagtaataggaat

SEQ ID NO: 4712 - DNA, 16 bp, Artificial sequence
  Synthetic oligonucleotide
catcagatttagtaat

SEQ ID NO: 4713 - DNA, 16 bp, Artificial sequence
  Synthetic oligonucleotide
gttattacatcagatt

SEQ ID NO: 4714 - DNA, 16 bp, Artificial sequence
  Synthetic oligonucleotide
gcctagaatcaataaa

SEQ ID NO: 4715 - DNA, 16 bp, Artificial sequence
  Synthetic oligonucleotide
aggaatgcctagaatc

SEQ ID NO: 4716 - DNA, 16 bp, Artificial sequence
  Synthetic oligonucleotide
ttcagcaggaatgcct

SEQ ID NO: 4717 - DNA, 16 bp, Artificial sequence
  Synthetic oligonucleotide
ttacctgatataacat

SEQ ID NO: 4718 - DNA, 16 bp, Artificial sequence
  Synthetic oligonucleotide
caggttttacctgata

SEQ ID NO: 4719 - DNA, 16 bp, Artificial sequence
  Synthetic oligonucleotide
cttagacaggttttac

SEQ ID NO: 4720 - DNA, 16 bp, Artificial sequence
  Synthetic oligonucleotide
attctccttagacagg

SEQ ID NO: 4721 - DNA, 16 bp, Artificial sequence
  Synthetic oligonucleotide
ctgtctattctcctta

SEQ ID NO: 4722 - DNA, 16 bp, Artificial sequence
  Synthetic oligonucleotide
taactactgtctattc

SEQ ID NO: 4723 - DNA, 16 bp, Artificial sequence
  Synthetic oligonucleotide
ttgaactaactactgt

SEQ ID NO: 4724 - DNA, 16 bp, Artificial sequence
  Synthetic oligonucleotide
agtaagttgaactaac

SEQ ID NO: 4725 - DNA, 16 bp, Artificial sequence
  Synthetic oligonucleotide
gtaatgagtaagttga

SEQ ID NO: 4726 - DNA, 16 bp, Artificial sequence
  Synthetic oligonucleotide
taatcttcctaatacg

SEQ ID NO: 4727 - DNA, 16 bp, Artificial sequence
  Synthetic oligonucleotide
accaggttaatcttcc

SEQ ID NO: 4728 - DNA, 16 bp, Artificial sequence
  Synthetic oligonucleotide
atgataaccaggttaa

SEQ ID NO: 4729 - DNA, 16 bp, Artificial sequence
  Synthetic oligonucleotide
cgaatactcatatata

SEQ ID NO: 4730 - DNA, 16 bp, Artificial sequence
  Synthetic oligonucleotide
tttatacgaatactca

SEQ ID NO: 4731 - DNA, 16 bp, Artificial sequence
  Synthetic oligonucleotide
attatatttatacgaa

SEQ ID NO: 4732 - DNA, 16 bp, Artificial sequence
  Synthetic oligonucleotide
ggtaaaagtattatat

SEQ ID NO: 4733 - DNA, 16 bp, Artificial sequence
  Synthetic oligonucleotide
gagaatattgagtaaa

SEQ ID NO: 4734 - DNA, 16 bp, Artificial sequence
  Synthetic oligonucleotide
cagattattttagagg

SEQ ID NO: 4735 - DNA, 16 bp, Artificial sequence
  Synthetic oligonucleotide
tcacttcagattattt

SEQ ID NO: 4736 - DNA, 16 bp, Artificial sequence
  Synthetic oligonucleotide
taatagtcacttcaga

SEQ ID NO: 4737 - DNA, 16 bp, Artificial sequence
  Synthetic oligonucleotide
tattgataatagtcac

SEQ ID NO: 4738 - DNA, 16 bp, Artificial sequence
  Synthetic oligonucleotide
tactatttgtaatcaa

SEQ ID NO: 4739 - DNA, 16 bp, Artificial sequence
  Synthetic oligonucleotide
cttgcttattttacta

SEQ ID NO: 4740 - DNA, 16 bp, Artificial sequence
  Synthetic oligonucleotide
catctgttattttatc

SEQ ID NO: 4741 - DNA, 16 bp, Artificial sequence
  Synthetic oligonucleotide
atgtgctttttggatt

SEQ ID NO: 4742 - DNA, 16 bp, Artificial sequence
  Synthetic oligonucleotide
ggatttttgtatgtgc

SEQ ID NO: 4743 - DNA, 16 bp, Artificial sequence
  Synthetic oligonucleotide
catcattcatggattt

SEQ ID NO: 4744 - DNA, 16 bp, Artificial sequence
  Synthetic oligonucleotide
cttagacatcattcat

SEQ ID NO: 4745 - DNA, 16 bp, Artificial sequence
  Synthetic oligonucleotide
tgagtacttagacatc

SEQ ID NO: 4746 - DNA, 16 bp, Artificial sequence
  Synthetic oligonucleotide
tataagtgagtactta

SEQ ID NO: 4747 - DNA, 16 bp, Artificial sequence
  Synthetic oligonucleotide
ctactttataagtgag

SEQ ID NO: 4748 - DNA, 16 bp, Artificial sequence
  Synthetic oligonucleotide
tgaatgtcttctactt

SEQ ID NO: 4749 - DNA, 16 bp, Artificial sequence
  Synthetic oligonucleotide
tataataatgaatgtc

SEQ ID NO: 4750 - DNA, 16 bp, Artificial sequence
  Synthetic oligonucleotide
gtactgagcatttaaa

SEQ ID NO: 4751 - DNA, 16 bp, Artificial sequence
  Synthetic oligonucleotide
caaatagtactgagca

SEQ ID NO: 4752 - DNA, 16 bp, Artificial sequence
  Synthetic oligonucleotide
aatggtcaaatagtac

SEQ ID NO: 4753 - DNA, 16 bp, Artificial sequence
  Synthetic oligonucleotide
gtagtttgaatacaaa

SEQ ID NO: 4754 - DNA, 16 bp, Artificial sequence
  Synthetic oligonucleotide
tcactggtagtttgaa

SEQ ID NO: 4755 - DNA, 16 bp, Artificial sequence
  Synthetic oligonucleotide
taggtagggctttcac

SEQ ID NO: 4756 - DNA, 16 bp, Artificial sequence
  Synthetic oligonucleotide
accttctaggtagggc

SEQ ID NO: 4757 - DNA, 16 bp, Artificial sequence
  Synthetic oligonucleotide
gagtataccttctagg

SEQ ID NO: 4758 - DNA, 16 bp, Artificial sequence
  Synthetic oligonucleotide
atcactgagtatacct

SEQ ID NO: 4759 - DNA, 16 bp, Artificial sequence
  Synthetic oligonucleotide
aaacttatcactgagt

SEQ ID NO: 4760 - DNA, 16 bp, Artificial sequence
  Synthetic oligonucleotide
gctacaaaacttatca

SEQ ID NO: 4761 - DNA, 16 bp, Artificial sequence
  Synthetic oligonucleotide
tttggagctacaaaac

SEQ ID NO: 4762 - DNA, 16 bp, Artificial sequence
  Synthetic oligonucleotide
agaagatttggagcta

SEQ ID NO: 4763 - DNA, 16 bp, Artificial sequence
  Synthetic oligonucleotide
actattagaagatttg

SEQ ID NO: 4764 - DNA, 16 bp, Artificial sequence
  Synthetic oligonucleotide
acactcactattagaa

SEQ ID NO: 4765 - DNA, 16 bp, Artificial sequence
  Synthetic oligonucleotide
agccttttattttggg

SEQ ID NO: 4766 - DNA, 16 bp, Artificial sequence
  Synthetic oligonucleotide
cctgtcagccttttat

SEQ ID NO: 4767 - DNA, 16 bp, Artificial sequence
  Synthetic oligonucleotide
gacttacctgtcagcc

SEQ ID NO: 4768 - DNA, 16 bp, Artificial sequence
  Synthetic oligonucleotide
attctcgacttacctg

SEQ ID NO: 4769 - DNA, 16 bp, Artificial sequence
  Synthetic oligonucleotide
gtgagtattctcgact

SEQ ID NO: 4770 - DNA, 16 bp, Artificial sequence
  Synthetic oligonucleotide
aattaagtgagtattc

SEQ ID NO: 4771 - DNA, 16 bp, Artificial sequence
  Synthetic oligonucleotide
taccagaattaagtga

SEQ ID NO: 4772 - DNA, 16 bp, Artificial sequence
  Synthetic oligonucleotide
gctttcttaccagaat

SEQ ID NO: 4773 - DNA, 16 bp, Artificial sequence
  Synthetic oligonucleotide
tgggttgctttcttac

SEQ ID NO: 4774 - DNA, 16 bp, Artificial sequence
  Synthetic oligonucleotide
tacaagtacaaatggg

SEQ ID NO: 4775 - DNA, 16 bp, Artificial sequence
  Synthetic oligonucleotide
ggtaaatacaagtaca

SEQ ID NO: 4776 - DNA, 16 bp, Artificial sequence
  Synthetic oligonucleotide
attgctggtaaataca

SEQ ID NO: 4777 - DNA, 16 bp, Artificial sequence
  Synthetic oligonucleotide
ttaaggattgctggta

SEQ ID NO: 4778 - DNA, 16 bp, Artificial sequence
  Synthetic oligonucleotide
gcttcattttaaggat

SEQ ID NO: 4779 - DNA, 16 bp, Artificial sequence
  Synthetic oligonucleotide
gtaggaagcttcattt

SEQ ID NO: 4780 - DNA, 16 bp, Artificial sequence
  Synthetic oligonucleotide
gagttagtaggaagct

SEQ ID NO: 4781 - DNA, 16 bp, Artificial sequence
  Synthetic oligonucleotide
gctattgagttagtag

SEQ ID NO: 4782 - DNA, 16 bp, Artificial sequence
  Synthetic oligonucleotide
cttattgctattgagt

SEQ ID NO: 4783 - DNA, 16 bp, Artificial sequence
  Synthetic oligonucleotide
tattgtcttattgcta

SEQ ID NO: 4784 - DNA, 16 bp, Artificial sequence
  Synthetic oligonucleotide
attcactattgtctta

SEQ ID NO: 4785 - DNA, 16 bp, Artificial sequence
  Synthetic oligonucleotide
atcacaatccttttta

SEQ ID NO: 4786 - DNA, 16 bp, Artificial sequence
  Synthetic oligonucleotide
ttcttcatcacaatcc

SEQ ID NO: 4787 - DNA, 16 bp, Artificial sequence
  Synthetic oligonucleotide
agattgttcttcatca

SEQ ID NO: 4788 - DNA, 16 bp, Artificial sequence
  Synthetic oligonucleotide
tataaatagattgttc

SEQ ID NO: 4789 - DNA, 16 bp, Artificial sequence
  Synthetic oligonucleotide
ggttcttaataacttt

SEQ ID NO: 4790 - DNA, 16 bp, Artificial sequence
  Synthetic oligonucleotide
aagcatggttcttaat

SEQ ID NO: 4791 - DNA, 16 bp, Artificial sequence
  Synthetic oligonucleotide
ctttgtagaaaaagac

SEQ ID NO: 4792 - DNA, 16 bp, Artificial sequence
  Synthetic oligonucleotide
tatgctttctttgtag

SEQ ID NO: 4793 - DNA, 16 bp, Artificial sequence
  Synthetic oligonucleotide
cttaatgtatgctttc

SEQ ID NO: 4794 - DNA, 16 bp, Artificial sequence
  Synthetic oligonucleotide
gtatttgcttaatgta

SEQ ID NO: 4795 - DNA, 16 bp, Artificial sequence
  Synthetic oligonucleotide
cctttggtatttgctt

SEQ ID NO: 4796 - DNA, 16 bp, Artificial sequence
  Synthetic oligonucleotide
acctggcctttggtat

SEQ ID NO: 4797 - DNA, 16 bp, Artificial sequence
  Synthetic oligonucleotide
atgtaaacctggcctt

SEQ ID NO: 4798 - DNA, 16 bp, Artificial sequence
  Synthetic oligonucleotide
cttcaaatgtaaacct

SEQ ID NO: 4799 - DNA, 16 bp, Artificial sequence
  Synthetic oligonucleotide
gtaataataatgtcac

SEQ ID NO: 4800 - DNA, 16 bp, Artificial sequence
  Synthetic oligonucleotide
agacttgagtaataat

SEQ ID NO: 4801 - DNA, 16 bp, Artificial sequence
  Synthetic oligonucleotide
tcctagagacttgagt

SEQ ID NO: 4802 - DNA, 16 bp, Artificial sequence
  Synthetic oligonucleotide
aagtattcctagagac

SEQ ID NO: 4803 - DNA, 16 bp, Artificial sequence
  Synthetic oligonucleotide
tgtgttaagtattcct

SEQ ID NO: 4804 - DNA, 16 bp, Artificial sequence
  Synthetic oligonucleotide
aagagatgtgttaagt

SEQ ID NO: 4805 - DNA, 16 bp, Artificial sequence
  Synthetic oligonucleotide
ccatatacagtcaaga

SEQ ID NO: 4806 - DNA, 16 bp, Artificial sequence
  Synthetic oligonucleotide
taacatccatatacag

SEQ ID NO: 4807 - DNA, 16 bp, Artificial sequence
  Synthetic oligonucleotide
ctatttattaacatcc

SEQ ID NO: 4808 - DNA, 16 bp, Artificial sequence
  Synthetic oligonucleotide
tgtcagctatttatta

SEQ ID NO: 4809 - DNA, 16 bp, Artificial sequence
  Synthetic oligonucleotide
ctttactgtcagctat

SEQ ID NO: 4810 - DNA, 16 bp, Artificial sequence
  Synthetic oligonucleotide
gataaactttactgtc

SEQ ID NO: 4811 - DNA, 16 bp, Artificial sequence
  Synthetic oligonucleotide
ctttatatggataaac

SEQ ID NO: 4812 - DNA, 16 bp, Artificial sequence
  Synthetic oligonucleotide
gcaagtctttatatgg

SEQ ID NO: 4813 - DNA, 20 bp, Artificial sequence
  Synthetic oligonucleotide
ctgggtattactcttttcta

SEQ ID NO: 4814 - DNA, 20 bp, Artificial sequence
  Synthetic oligonucleotide
cttgctgggtattactcttt

SEQ ID NO: 4815 - DNA, 20 bp, Artificial sequence
  Synthetic oligonucleotide
tgcttgctgggtattactct

SEQ ID NO: 4816 - DNA, 20 bp, Artificial sequence
  Synthetic oligonucleotide
catgaatgatatttcctagg

SEQ ID NO: 4817 - DNA, 20 bp, Artificial sequence
  Synthetic oligonucleotide
ggcatgaatgatatttccta

SEQ ID NO: 4818 - DNA, 20 bp, Artificial sequence
  Synthetic oligonucleotide
ctggcatgaatgatatttcc

SEQ ID NO: 4819 - DNA, 20 bp, Artificial sequence
  Synthetic oligonucleotide
tgctggcatgaatgatattt

SEQ ID NO: 4820 - DNA, 20 bp, Artificial sequence
  Synthetic oligonucleotide
aagtccatatttgtatttct

SEQ ID NO: 4821 - DNA, 20 bp, Artificial sequence
  Synthetic oligonucleotide
gcaaatgtagcattttttca

SEQ ID NO: 4822 - DNA, 20 bp, Artificial sequence
  Synthetic oligonucleotide
ggcaaatgtagcattttttc

SEQ ID NO: 4823 - DNA, 20 bp, Artificial sequence
  Synthetic oligonucleotide
ctggtccttttaacttccaa

SEQ ID NO: 4824 - DNA, 20 bp, Artificial sequence
  Synthetic oligonucleotide
cctggtccttttaacttcca

SEQ ID NO: 4825 - DNA, 20 bp, Artificial sequence
  Synthetic oligonucleotide
ttcctggtccttttaacttc

SEQ ID NO: 4826 - DNA, 20 bp, Artificial sequence
  Synthetic oligonucleotide
tgcttaatgtatgctttctt

SEQ ID NO: 4827 - DNA, 20 bp, Artificial sequence
  Synthetic oligonucleotide
ccgtaagtttatcttccttt

SEQ ID NO: 4828 - DNA, 20 bp, Artificial sequence
  Synthetic oligonucleotide
ccccgtaagtttatcttcct

SEQ ID NO: 4829 - DNA, 20 bp, Artificial sequence
  Synthetic oligonucleotide
cacaaatatgttcattctta

SEQ ID NO: 4830 - DNA, 20 bp, Artificial sequence
  Synthetic oligonucleotide
aaactttaactcgatgccac

SEQ ID NO: 4831 - DNA, 20 bp, Artificial sequence
  Synthetic oligonucleotide
ataaactttaactcgatgcc

SEQ ID NO: 4832 - DNA, 20 bp, Artificial sequence
  Synthetic oligonucleotide
atgcttgtcaggctgtttaa

SEQ ID NO: 4833 - DNA, 20 bp, Artificial sequence
  Synthetic oligonucleotide
gtcaccatataacttgggca

SEQ ID NO: 4834 - DNA, 20 bp, Artificial sequence
  Synthetic oligonucleotide
aggtcaccatataacttggg

SEQ ID NO: 4835 - DNA, 17 bp, Artificial sequence
  Synthetic oligonucleotide
gctgggtattactcttt

SEQ ID NO: 4836 - DNA, 17 bp, Artificial sequence
  Synthetic oligonucleotide
gcatgaatgatatttcc

SEQ ID NO: 4837 - DNA, 17 bp, Artificial sequence
  Synthetic oligonucleotide
ggcaaatgtagcatttt

SEQ ID NO: 4838 - DNA, 17 bp, Artificial sequence
  Synthetic oligonucleotide
ctggtccttttaacttc

SEQ ID NO: 4839 - DNA, 17 bp, Artificial sequence
  Synthetic oligonucleotide
gtaagtttatcttcctt

SEQ ID NO: 4840 - DNA, 17 bp, Artificial sequence
  Synthetic oligonucleotide
actttaactcgatgcca

SEQ ID NO: 4841 - DNA, 17 bp, Artificial sequence
  Synthetic oligonucleotide
aactttaactcgatgcc

SEQ ID NO: 4842 - DNA, 17 bp, Artificial sequence
  Synthetic oligonucleotide
aaactttaactcgatgc

SEQ ID NO: 4843 - DNA, 17 bp, Artificial sequence
  Synthetic oligonucleotide
caccatataacttgggc

SEQ ID NO: 4844 - DNA, 17 bp, Artificial sequence
  Synthetic oligonucleotide
tcaccatataacttggg

SEQ ID NO: 4845 - DNA, 17 bp, Artificial sequence
  Synthetic oligonucleotide
gtcaccatataacttgg

SEQ ID NO: 4846 - DNA, 20 bp, Artificial sequence
  Synthetic oligonucleotide
cttgattttggctctggaga

SEQ ID NO: 4847 - DNA, 17 bp, Artificial sequence
  Synthetic oligonucleotide
tgattttggctctggag

SEQ ID NO: 4848 - DNA, 17 bp, Artificial sequence
  Synthetic oligonucleotide
actggtttgcagcgata

SEQ ID NO: 4849 - DNA, 20 bp, Artificial sequence
  Synthetic oligonucleotide
tttcactggtttgcagcgat

SEQ ID NO: 4850 - DNA, 17 bp, Artificial sequence
  Synthetic oligonucleotide
cactggtttgcagcgat

SEQ ID NO: 4851 - DNA, 17 bp, Artificial sequence
  Synthetic oligonucleotide
tcactggtttgcagcga

SEQ ID NO: 4852 - DNA, 17 bp, Artificial sequence
  Synthetic oligonucleotide
ttcttggtgctcttggc

SEQ ID NO: 4853 - DNA, 17 bp, Artificial sequence
  Synthetic oligonucleotide
gttcttggtgctcttgg

SEQ ID NO: 4854 - DNA, 20 bp, Artificial sequence
  Synthetic oligonucleotide
ttgtctttccagtcttccaa

SEQ ID NO: 4855 - DNA, 20 bp, Artificial sequence
  Synthetic oligonucleotide
tgttgtctttccagtcttcc

SEQ ID NO: 4856 - DNA, 17 bp, Artificial sequence
  Synthetic oligonucleotide
cattgccagtaatcgca

SEQ ID NO: 4857 - DNA, 17 bp, Artificial sequence
  Synthetic oligonucleotide
acattgccagtaatcgc

SEQ ID NO: 4858 - DNA, 17 bp, Artificial sequence
  Synthetic oligonucleotide
gacattgccagtaatcg

SEQ ID NO: 4859 - DNA, 20 bp, Artificial sequence
  Synthetic oligonucleotide
ctttgtgatcccaagtagaa

SEQ ID NO: 4860 - DNA, 17 bp, Artificial sequence
  Synthetic oligonucleotide
ttgtgatcccaagtaga

SEQ ID NO: 4861 - DNA, 20 bp, Artificial sequence
  Synthetic oligonucleotide
tgctttgtgatcccaagtag

SEQ ID NO: 4862 - DNA, 17 bp, Artificial sequence
  Synthetic oligonucleotide
tttgtgatcccaagtag

SEQ ID NO: 4863 - DNA, 17 bp, Artificial sequence
  Synthetic oligonucleotide
ctttgtgatcccaagta

SEQ ID NO: 4864 - DNA, 17 bp, Artificial sequence
  Synthetic oligonucleotide
cacactcatcatgccac

SEQ ID NO: 4865 - DNA, 20 bp, Artificial sequence
  Synthetic oligonucleotide
gttgttttctccacactcat

SEQ ID NO: 4866 - DNA, 17 bp, Artificial sequence
  Synthetic oligonucleotide
agattttgctcttggtt

SEQ ID NO: 4867 - DNA, 17 bp, Artificial sequence
  Synthetic oligonucleotide
tagattttgctcttggt

SEQ ID NO: 4868 - DNA, 17 bp, Artificial sequence
  Synthetic oligonucleotide
ttagattttgctcttgg

SEQ ID NO: 4869 - DNA, 17 bp, Artificial sequence
  Synthetic oligonucleotide
cttagattttgctcttg

SEQ ID NO: 4870 - DNA, 17 bp, Artificial sequence
  Synthetic oligonucleotide
agattattagaccacat

SEQ ID NO: 4871 - DNA, 17 bp, Artificial sequence
  Synthetic oligonucleotide
cagattattagaccaca

SEQ ID NO: 4872 - DNA, 17 bp, Artificial sequence
  Synthetic oligonucleotide
accagattattagacca

SEQ ID NO: 4873 - DNA, 17 bp, Artificial sequence
  Synthetic oligonucleotide
acatactctgtgctgac

SEQ ID NO: 4874 - DNA, 20 bp, Artificial sequence
  Synthetic oligonucleotide
ttacacatactctgtgctga

SEQ ID NO: 4875 - DNA, 17 bp, Artificial sequence
  Synthetic oligonucleotide
cttagtagtcatctcca

SEQ ID NO: 4876 - DNA, 17 bp, Artificial sequence
  Synthetic oligonucleotide
acttagtagtcatctcc

SEQ ID NO: 4877 - DNA, 17 bp, Artificial sequence
  Synthetic oligonucleotide
gacttagtagtcatctc

What is claimed is:

1. A compound comprising a modified oligonucleotide consisting of 19 or 20 linked nucleosides, wherein at least 19 contiguous nucleobases are complementary to an equal length of nucleobases 1140 to 1159 of SEQ ID NO:1 and wherein the modified oligonucleotide comprises at least one modification selected from the group consisting of (i) a modified sugar, (ii) a modified internucleoside linkage, and (iii) a modified nucleobase,
or a salt thereof.

2. The compound or salt of claim 1, wherein the modified oligonucleotide consists of 19 contiguous nucleobases of SEQ ID NO:77.

3. The compound or salt of claim 1, wherein the modified oligonucleotide consists of the 20 contiguous nucleobases of SEQ ID NO:77.

4. The compound or salt of claim 1, wherein the modified oligonucleotide is single-stranded.

5. The compound or salt of claim 1, which comprises the modified internucleoside linkage.

6. The compound or salt of claim 5, wherein the modified internucleoside linkage is a phosphorothioate internucleoside linkage.

7. The compound or salt of claim 1, wherein the modified oligonucleotide comprises the modified sugar.

8. The compound or salt of claim 7, wherein the modified sugar is a bicyclic sugar.

9. The compound or salt of claim 7, wherein the modified sugar comprises a 2'-O-methoxyethyl, a constrained ethyl, a 3'-fluoro-HNA or a 4'-$(CH_2)_n$-O-2' bridge, wherein n is 1 or 2.

10. The compound or salt of claim 1, wherein the modified oligonucleotide comprises the modified nucleobase.

11. The compound or salt of claim 10, wherein the modified nucleobase is a 5-methylcytosine.

12. The compound or salt of claim 1, wherein the modified oligonucleotide comprises:
a gap segment consisting of linked deoxynucleosides;
a 5' wing segment consisting of linked nucleosides;
a 3' wing segment consisting of linked nucleosides;
wherein the gap segment is positioned between the 5' wing segment and the 3' wing segment and
wherein each nucleoside of each wing segment comprises a modified sugar.

13. The compound or salt of claim 12, wherein the modified oligonucleotide consists of 20 linked nucleosides and comprises:
a gap segment consisting of ten linked deoxynucleosides;
a 5' wing segment consisting of five linked nucleosides;
a 3' wing segment consisting of five linked nucleosides;
wherein the gap segment is positioned between the 5' wing segment and the 3' wing segment,
wherein each nucleoside of each wing segment comprises a 2'-O-methoxyethyl sugar, wherein each internucleoside linkage is a phosphorothioate linkage and wherein each cytosine residue is a 5-methylcytosine.

14. The compound or salt of claim 12, wherein the modified oligonucleotide consists of 20 linked nucleosides.

15. A composition comprising the compound or salt of claim 1, and a pharmaceutically acceptable carrier or diluent.

16. The composition of claim 15, wherein the composition comprises the salt of claim 1.

* * * * *